United States Patent
McIninch et al.

(10) Patent No.: US 11,326,166 B1
(45) Date of Patent: May 10, 2022

(54) XANTHINE DEHYDROGENASE (XDH) IRNA COMPOSITIONS AND METHODS OF USE THEREOF

(71) Applicant: Alnylam Pharmaceuticals, Inc., Cambridge, MA (US)

(72) Inventors: James D. McIninch, Burlington, MA (US); Jingxuan Liu, West Roxbury, MA (US); Mark K. Schlegel, Boston, MA (US); Adam Castoreno, Framingham, MA (US); Anna Borodovsky, Melrose, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 17/505,732

(22) Filed: Oct. 20, 2021

Related U.S. Application Data

(63) Continuation of application No. PCT/US2021/037748, filed on Jun. 17, 2021.

(60) Provisional application No. 63/153,983, filed on Feb. 26, 2021, provisional application No. 63/040,587, filed on Jun. 18, 2020.

(51) Int. Cl.
*C12N 15/113* (2010.01)
*A61K 47/54* (2017.01)
*A61K 31/713* (2006.01)

(52) U.S. Cl.
CPC ........ *C12N 15/1137* (2013.01); *A61K 31/713* (2013.01); *A61K 47/549* (2017.08); *C12N 2310/14* (2013.01); *C12N 2310/315* (2013.01); *C12N 2310/351* (2013.01)

(58) Field of Classification Search
None
See application file for complete search history.

(56) References Cited

U.S. PATENT DOCUMENTS

| 8,106,022 B2 | 1/2012 | Manoharan et al. |
| 2008/0113351 A1 | 5/2008 | Naito et al. |
| 2011/0046206 A1 | 2/2011 | Bhat et al. |
| 2018/0216114 A1 | 8/2018 | Fitzgerald et al. |

FOREIGN PATENT DOCUMENTS

| CN | 104232644 A | | 12/2014 | |
| EP | 1752536 A1 | | 2/2007 | |
| WO | WO-2006040357 A2 | | 4/2006 | |
| WO | WO-2012118911 A1 | | 9/2012 | |
| WO | WO-2017019660 A1 | | 2/2017 | |
| WO | WO-2020238766 A1 | * | 12/2020 | ............ A61K 47/14 |

OTHER PUBLICATIONS

Machine translation of WO2020238766, Dec. 8, 2021, 87 pages.*
International Search Report and Written Opinion from PCT/US2016/043985 dated Oct. 31, 2016.
Reynolds et al., "Rational siRNA design for RNA interference," Nature Biotechnology, vol. 22, pp. 326-330, 2004.

* cited by examiner

*Primary Examiner* — Tracy Vivlemore
(74) *Attorney, Agent, or Firm* — McCarter & English, LLP; Maria Laccotripe Zacharakis; Deborah L. Nagle

(57) ABSTRACT

The present invention relates to RNAi agents, e.g., dsRNA agents, targeting the xanthine dehydrogenase (XDH) gene. The invention also relates to methods of using such RNAi agents to inhibit expression of an XDH gene and to methods of treating or preventing an XDH-associated disease in a subject.

29 Claims, 3 Drawing Sheets
Specification includes a Sequence Listing.

XANTHINE DEHYDROGENASE (XDH) IRNA COMPOSITIONS AND METHODS OF USE THEREOF

RELATED APPLICATIONS

This application is a 35 § U.S.C. 111(a) continuation application which claims the benefit of priority to PCT/US2021/037748, filed on Jun. 17, 2021, which-in turn-claims the benefit of priority to U.S. Provisional Application No. 63/040,587, filed on Jun. 18, 2020, and U.S. Provisional Application No. 63/153,983, filed on Feb. 26, 2021. The entire contents of each of the foregoing applications are incorporated herein by reference.

SEQUENCE LISTING

The instant application contains a Sequence Listing which has been submitted electronically in ASCII format and is hereby incorporated by reference in its entirety. Said ASCII copy, created on Oct. 14, 2021, is named 121301_12903_SL.txt and is 714,599 bytes in size.

BACKGROUND OF THE INVENTION

Reduced renal clearance of uric acid is the result of a number of factors, including defects in uric acid transporter proteins such as SLC2A9, ABCG2, and others, reduced renal excretion due to renal disease, hypothyroidism, volume contraction and volume depletion, acidosis, lead intoxication, and familial nephropathy due to uromodulin deposits; and altered renal clearance due to hyperinsulinemia or insulin resistance in diabetes. Increased synthesis of uric acid is associated with hyperuricemia plus hyperuricosuria; inborn errors of metabolism such as Lesch Nyhan/HPRT deficiency, PRPP synthetase overactivity, and glucose-6-phosphate dehydrogenase deficiency (Von Gierke disease/Glycogen Storage Disease Type Ia); certain situations of high cell turnover (e.g., tumor lysis syndrome); certain situations of high ATP turnover (e.g., glycogen storage diseases, tissue ischemia). Furthermore, conditions such as chronic kidney disease, hypertension, metabolic syndrome, and high fructose intake may result in both increased uric acid synthesis and decreased uric acid clearance.

Chronic elevated serum uric acid (chronic hyperuricemia), typically defined as serum urate levels greater than 6.8 mg/dl (greater than 360 mmol/), the level above which the physiological saturation threshold is exceeded (Mandell, *Cleve. Clin. Med.* 75:S5-S8, 2008), is associated with a number of diseases. For example, gout is characterized by recurrent attacks of acute inflammatory arthritis that is caused by an inflammatory reaction to uric acid crystals in the joint typically due to insufficient renal clearance of uric acid or excessive uric acid production. Fructose associated gout is associated with variants of transporters expressed in the kidney, intestine, and liver. Chronic elevated uric acid is also associated with non-alcoholic steatohepatitis (NASH), non-alcoholic fatty liver disease (NAFLD), metabolic disorder, cardiovascular disease, type 2 diabetes, and conditions linked to oxidative stress, chronic low grade inflammation, and insulin resistance (Xu et al., *J. Hepatol.* 62:1412-1419, 2015; Cardoso et al., *J. Pediatr.* 89:412-418, 2013; Sertoglu et al., *Clin. Biochem.*, 47:383-388, 2014).

Uric acid (also referred to herein as urate) is the final metabolite of endogenous and dietary purine metabolism. Xanthine oxidase (XO) (EC 1.1.3.22) and xanthine dehydrogenase (XDH) (EC 1.17.1.4), which catalyze the oxidation of hypoxanthine to xanthine, and xanthine to uric acid, respectively, are interconvertible forms of the same enzyme. The enzymes are molybdopterin-containing flavoproteins that consist of two identical subunits of approximately 145 kDa. The enzyme from mammalian sources, including man, is synthesized as the dehydrogenase form, but it can be readily converted to the oxidase form by oxidation of sulfhydryl residues or by proteolysis. XDH is primarily expressed in the intestine and the liver, but it is also expressed in other tissues including adipose tissue.

Allopurinol and febuxostat (Uloric®), inhibitors of the XDH form of the enzyme, are commonly used for the treatment of gout. However, their use is contraindicated in patients with co-morbidities common to gout, especially decreased renal function, e.g., due to chronic kidney disease or hepatic impairment. Their use may also be limited in patients with metabolic syndrome, hypertension, dyslipidemia, non-alcoholic steatohepatitis (NASH) or non-alcoholic fatty liver disease (NAFLD), cardiovascular disease, or diabetes (either type 1 or type 2), due to limited organ function from the disease or condition, or due to adverse drug interactions with agents used for the treatment of such conditions.

Currently, treatments for gout do not fully meet patient needs. Therefore, there is a need for additional therapies for subjects that would benefit from reduction in the expression of an XDH gene, such as a subject having an XDH-associated disease or disorder, e.g., gout.

SUMMARY OF THE INVENTION

The present invention provides iRNA compositions which affect the RNA-induced silencing complex (RISC)-mediated cleavage of RNA transcripts of a gene encoding xanthine dehydrogenase (XDH). The XDH may be within a cell, e.g., a cell within a subject, such as a human subject.

Accordingly, in one aspect the invention provides a double stranded ribonucleic acid (dsRNA) agent for inhibiting expression of XDH in a cell, wherein the dsRNA agent comprises a sense strand and an antisense strand forming a double stranded region, wherein the sense strand comprises at least 15 contiguous nucleotides differing by no more than 0, 1, 2, or 3 nucleotides from the nucleotide sequence of SEQ ID NO:1 and the antisense strand comprises at least 15 contiguous nucleotides differing by no more than 1, 2, or 3 nucleotides from the nucleotide sequence of SEQ ID NO:2. In certain embodiments, the sense strand comprises at least 15 contiguous nucleotides of the nucleotide sequence of SEQ ID NO:1 and the antisense strand comprises at least 15 contiguous nucleotides of the nucleotide sequence of SEQ ID NO:2. In certain embodiments, the sense strand comprises at least 17 contiguous nucleotides of the nucleotide sequence of SEQ ID NO:1 and the antisense strand comprises at least 17 contiguous nucleotides of the nucleotide sequence of SEQ ID NO:2. In certain embodiments, the sense strand comprises at least 19 contiguous nucleotides of the nucleotide sequence of SEQ ID NO:1 and the antisense strand comprises at least 19 contiguous nucleotides of the nucleotide sequence of SEQ ID NO:2.

In another aspect, the present invention provides a double stranded ribonucleic acid (dsRNA) for inhibiting expression of xanthine dehydrogenase (XDH) in a cell, wherein said dsRNA comprises a sense strand and an antisense strand forming a double stranded region, wherein the antisense strand comprises a region of complementarity to an mRNA encoding XDH, and wherein the region of complementarity comprises at least 15 contiguous nucleotides differing by no more than 0, 1, 2, or 3 nucleotides from any one of the antisense nucleotide sequences in any one of Tables 2-3 and 6-7. In certain embodiments, the region of complementarity comprises at least 15 contiguous nucleotides of any one of the antisense nucleotide sequences in any one of Tables 2-3 and 6-7. In certain embodiments, the region of complementarity comprises at least 17 contiguous nucleotides of any one of the antisense nucleotide sequences in any one of Tables 2-3 and 6-7. In certain embodiments, the region of complementarity comprises at least 19 contiguous nucleotides of any one of the antisense nucleotide sequences in any one of Tables 2-3 and 6-7. In certain embodiments, the region of complementarity comprises at least 20 contiguous nucleotides of any one of the antisense nucleotide sequences in any one of Tables 2-3 and 6-7. In certain embodiments, the region of complementarity comprises at least 21 contiguous nucleotides of any one of the antisense nucleotide sequences in any one of Tables 2-3 and 6-7.

In one aspect, the present invention provides a double stranded ribonucleic acid (dsRNA) for inhibiting expression of xanthine dehydrogenase (XDH) in a cell, wherein said dsRNA comprises a sense strand and an antisense strand forming a double stranded region, wherein the sense strand comprises at least 15 contiguous nucleotides differing by no more than 3 nucleotides from any one of the nucleotide sequences of nucleotides 226-269; 1318-1352; 1953-1998; 2351-2394; 2679-2730; 3867-3916; or 4510-4574 of SEQ ID NO: 1, and the antisense strand comprises at least 15 contiguous nucleotides from the corresponding nucleotide sequence of SEQ ID NO: 2.

In one aspect, the present invention provides a double stranded ribonucleic acid (dsRNA) for inhibiting expression of xanthine dehydrogenase (XDH) in a cell, wherein said dsRNA comprises a sense strand and an antisense strand forming a double stranded region, wherein the sense strand comprises at least 15 contiguous nucleotides differing by no more than 3 nucleotides from any one of the nucleotide sequences of nucleotides 15-45; 121-162; 226-292; 306-338; 379-402; 428-458; 495-521; 873-907; 1318-1344; 1381-1407; 1604-1643; 1700-1723; 1960-1991; 1996-2029; 2044-2067; 2128-2174; 2186-2208; 2289-2345; 2359-2419; 2689-2722; 2699-2721; 2774-2797; 2930-2958; 2987-3064; 3083-3158; 3195-3221; 3248-3293; 3352-3405; 3460-3520; 3524-3571; 3575-3644; 3870-3963; 4143-4176; 4259-4315; 4355-4379; 4395-4467; 4502-4562; 4577-4648; 4658-4752; 4815-4854; 5199-5277; 5284-5310; 5358-5446; or 5677-5713 of SEQ ID NO: 1, and the antisense strand comprises at least 15 contiguous nucleotides from the corresponding nucleotide sequence of SEQ ID NO: 2.

In one aspect, the present invention provides a double stranded ribonucleic acid (dsRNA) for inhibiting expression of xanthine dehydrogenase (XDH) in a cell, wherein said dsRNA comprises a sense strand and an antisense strand forming a double stranded region, wherein the sense strand comprises at least 15 contiguous nucleotides differing by no more than 3 nucleotides from any one of the nucleotide sequences of nucleotides 123-143; 229-249; 229-251; 230-250; 237-259; 241-263; 271-291; 1320-1342; 1321-1341; 1965-1987; 1971-1993; 2130-2150; 2682-2704; 2689-2711; 2690-2710; 2699-2721; 3880-3900; or 3883-3903 of SEQ ID NO: 2, and the antisense strand comprises at least 15 contiguous nucleotides from the corresponding nucleotide sequence of SEQ ID NO: 2.

In some embodiments, the antisense strand comprises at least 15 contiguous nucleotides differing by nor more than three nucleotides from any one of the antisense strand nucleotide sequences of a duplex selected from the group consisting of AD-1395794.1; AD-1136038.3; AD-1395797.1; AD-1135991.3; AD-1297597.2; AD-1395803.1; AD-1395805.1; AD-1395807.1; AD-1395811.1; AD-1297663.2; AD-1136008.2; AD-1395816.1; AD-1136061.2; AD-1135987.2; AD-1395823.1; AD-1136166.3; and AD-1136169.

In some embodiments, the antisense strand comprises at least 15 contiguous nucleotides differing by no more than three nucleotides from any one of the antisense strand nucleotide sequences of a duplex selected from the group consisting of AD-1136091, AD-1395794, AD-1395805, AD-1136008, AD-1136038, AD-1395823, AD-1395816, AD-1136061, AD-1395811, and AD-1136166.

In some embodiments, the sense strand comprises at least 15 contiguous nucleotides differing by no more than 3 nucleotides from the nucleotide sequences of nucleotides 2699-2721 of SEQ ID NO:1, and the antisense strand comprises at least 15 contiguous nucleotides from the corresponding nucleotide sequence of SEQ ID NO: 2.

In some embodiments, the antisense strand comprises at least 15 contiguous nucleotides differing by no more than three nucleotides from the antisense strand nucleotide sequence of duplex AD-1136091.

In one embodiment, the dsRNA agent comprises at least one modified nucleotide.

In one embodiment, substantially all of the nucleotides of the sense strand; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a nucleotide comprising a 2'-phosphate, e.g., cytidine-2'-phosphate (C2p); guanosine-2'-phosphate (G2p); uridine-2'-phosphate (U2p); adenosine-2'-phosphate (A2p); a thermally destabilizing nucleotide, a glycol modified nucleotide (GNA), and a 2-O-(N-methylacetamide) modified nucleotide; and combinations thereof.

In one embodiment, the modifications on the nucleotides are selected from the group consisting of LNA, glycol nucleic acid (GNA), hexitol nucleic acid (HNA), CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxy-nucleotide, a 2'-O-methyl modified nucleotide, a 2'-fluoro modified nucleotide, a 2'-deoxy-modified nucleotide, a nucleotide comprising a 2'-phosphate, a glycol modified nucleotide (GNA), e.g., Ggn, Cgn, Tgn, or Agn, and, a vinyl-phosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acid (UNA), and a glycerol nucleic acid (GNA).

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; 19-23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

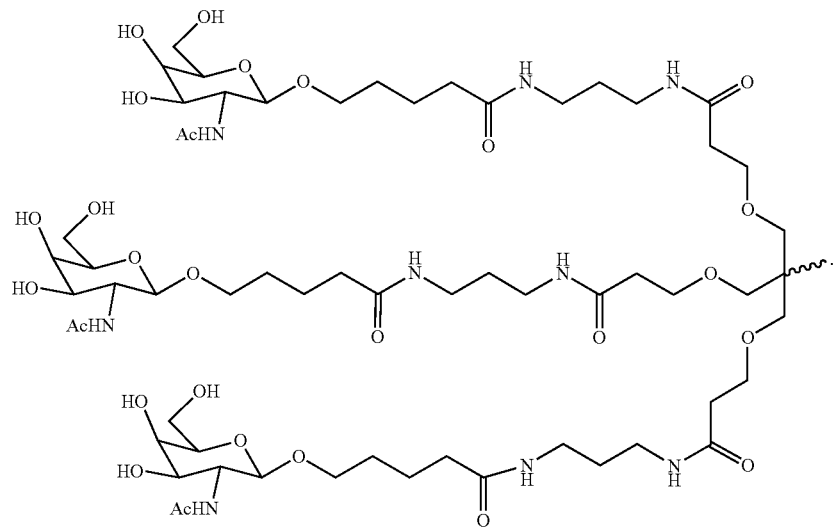 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

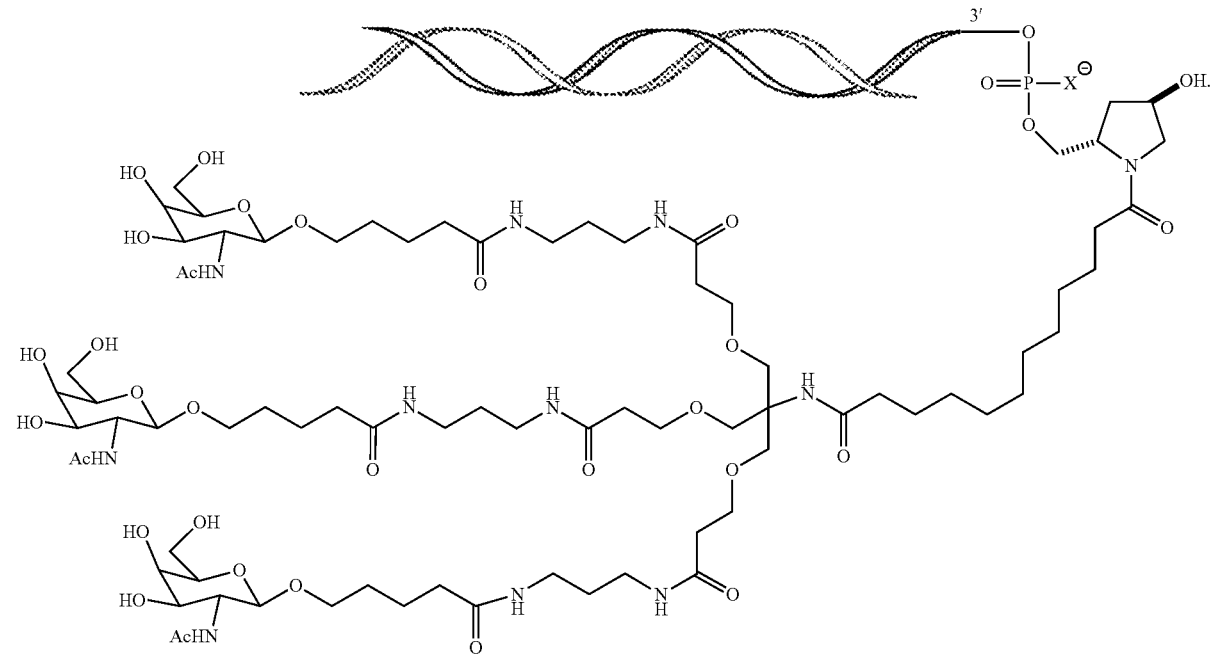

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a xanthine dehydrogenase (XDH) gene in a cell. The method includes contacting the cell with any of the dsRNAs of the invention or any of the pharmaceutical compositions of the invention, thereby inhibiting expression of the XDH gene in the cell.

In one embodiment, the cell is within a subject, e.g., a human subject, e.g., a subject having a xanthine dehydrogenase-(XDH)-associated disease. Such diseases are typically associated with excess uric acid, e.g., serum uric acid.

In one embodiment, the XDH-associated disease is hyperuricemia. In another embodiment, the XDH-associated disease is gout.

In one embodiment, contacting the cell with the dsRNA agent inhibits the expression of XDH by at least 50%, 60%, 70%, 80%, 90%, or 95%.

In one embodiment, inhibiting expression of XDH decreases XDH protein level in serum of the subject by at least 50%, 60%, 70%, 80%, 90%, or 95%.

In one aspect, the present invention provides a method of treating a subject having a disorder that would benefit from reduction in xanthine dehydrogenase (XDH) expression. The method includes administering to the subject a therapeutically effective amount of any of the dsRNAs of the invention or any of the pharmaceutical compositions of the invention, thereby treating the subject having the disorder that would benefit from reduction in XDH expression.

In another aspect, the present invention provides a method of preventing development of a disorder that would benefit from reduction in xanthine dehydrogenase (XDH) expression in a subject having at least one sign or symptom of a disorder who does not yet meet the diagnostic criteria for that disorder. The method includes administering to the subject a prophylactically effective amount of any of the dsRNAs of the invention or any of the pharmaceutical compositions of the invention, thereby preventing the subject progressing to meet the diagnostic criteria of the disorder that would benefit from reduction in XDH expression.

In one embodiment, the disorder is a xanthine dehydrogenase-(XDH)-associated disorder.

In one embodiment, the subject is human.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the level of XDH in the subject sample(s) is an XDH protein level in a blood or serum sample(s).

In one embodiment, the administration of the agent to the subject causes a decrease in the level of uric acid (e.g., serum uric acid) or a decrease in XDH protein accumulation.

In certain embodiments, the methods of the invention further comprise administering to the subject an additional therapeutic agent.

In certain embodiments, the compositions and methods of the invention are used in combination with other compositions and methods to treat hyperuricemia and/or gout, e.g., allopurinol, oxypurinol, febuxostat, analgesic or anti-inflammatory agents, e.g., NSAIDS.

The present invention also provides kits comprising any of the dsRNAs of the invention or any of the pharmaceutical compositions of the invention, and optionally, instructions for use.

DETAILED DESCRIPTION OF THE INVENTION

Figure 1:
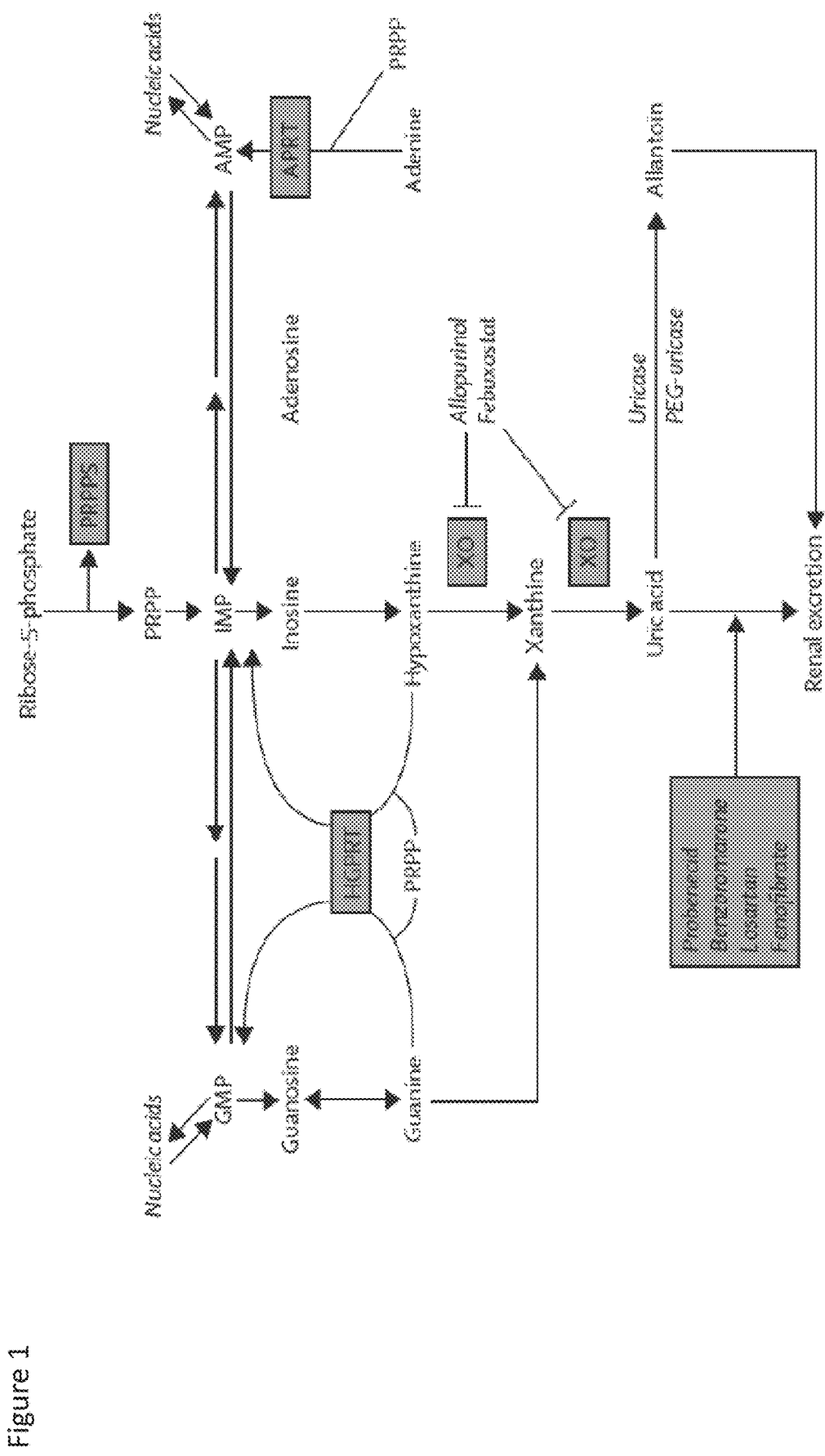
FIG. 1 is a schematic showing the uric acid metabolic pathway. XDH is labeled as XO in the schematic.

The present invention provides iRNA compositions which effect the RNA-induced silencing complex (RISC)-mediated cleavage of RNA transcripts of a xanthine dehydrogenase (XDH) gene. The gene may be within a cell, e.g., a cell within a subject, such as a human. The use of these iRNAs enables the targeted degradation of mRNAs of the corresponding gene (xanthine dehydrogenase gene) in mammals.

The iRNAs of the invention have been designed to target the human xanthine dehydrogenase gene, including portions of the gene that are conserved in the xanthine dehydrogenase orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a xanthine dehydrogenase-associated disorder, disease, or condition, e.g., a disorder, disease, or condition associated with elevated serum uric acid levels, e.g., hyperuricemia and gout, using iRNA compositions which effect the RNA-induced silencing complex (RISC)-mediated cleavage of RNA transcripts of a xanthine dehydrogenase gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a xanthine dehydrogenase gene. In certain embodiments, the RNAi agents of the disclosure include an RNA strand (the antisense strand) having a region which is about 21-23 nucleotides in length, which region is substantially complementary to at least part of an mRNA transcript of a xanthine dehydrogenase gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a xanthine dehydrogenase gene. In some embodiments, such iRNA agents having longer length antisense strands can, for example, include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (xanthine dehydrogenase gene) in mammals. Using in vitro and in vivo assays, the present inventors have demonstrated that iRNAs targeting a xanthine dehydrogenase gene can potently mediate RNAi, resulting in significant inhibition of expression of a xanthine dehydrogenase gene. Thus, methods and compositions including these iRNAs are useful for treating a subject having a xanthine dehydrogenase-associated disorder, e.g., hyperuricemia and gout.

Accordingly, the present invention provides methods and combination therapies for treating a subject having a disorder that would benefit from inhibiting or reducing the expression of a xanthine dehydrogenase gene, e.g., a xanthine dehydrogenase-associated disease, such as hyperuricemia and gout, using iRNA compositions which effect the RNA-induced silencing complex (RISC)-mediated cleavage of RNA transcripts of an XDH gene.

The present invention also provides methods for preventing at least one symptom in a subject having a disorder that would benefit from inhibiting or reducing the expression of a xanthine dehydrogenase gene, e.g., hyperuricemia and gout.

In certain embodiments, the administration of the dsRNA to the subject causes a decrease in XDH mRNA level, XDH protein level, and the level of serum uric acid.

The following detailed description discloses how to make and use compositions containing iRNAs to inhibit the expression of a xanthine dehydrogenase gene as well as compositions, uses, and methods for treating subjects that would benefit from inhibition or reduction of the expression of a xanthine dehydrogenase gene, e.g., subjects susceptible to or diagnosed with a xanthine dehydrogenase-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, the term "xanthine dehydrogenase," used interchangeably with the term "XDH," refers to the well-known gene and polypeptide, also known in the art as Xanthine Dehydrogenase/Oxidase, Xanthine Oxidoreductase, XAN1, XDHA, XOR, XO, EC 1.17.1.4, and EC 1.7.2.2.

XDH belongs to the group of molybdenum-containing hydroxylases involved in the oxidative metabolism of purines. The encoded protein has been identified as a moonlighting protein based on its ability to perform mechanistically distinct functions. Xanthine dehydrogenase can be converted to xanthine oxidase by reversible sulfhydryl oxidation or by irreversible proteolytic modification. As used herein, unless clear from context, xanthine dehydrogenase or XDH is understood to include both the xanthine dehydrogenase and xanthine oxidase ("XO" or "XOR") form of the protein. The protein is expressed predominantly in the intestine and the liver, but is also expressed in adipose tissue. Two transcript variants have been identified for the human isoform of the gene.

The term "XDH" includes human XDH, the amino acid and nucleotide sequence of which may be found in, for example, GenBank Accession Nos. GI:91823270, GI:1519244313, and GI:767915203; mouse XDH, the amino acid and nucleotide sequence of which may be found in, for example, GenBank Accession No. GI:575501724; rat XDH, the amino acid and nucleotide sequence of which may be found in, for example, GenBank Accession No. GI:8394543; and *Macaca fascicularis* XDH, transcript variant X1, the amino acid and nucleotide sequence of which may be found in, for example, GenBank Accession Nos. GI:544482046 and GI:544482048. Additional examples of XDH mRNA sequences are readily available using, e.g., GenBank, UniProt, OMIM, and the *Macaca* genome project web site.

Exemplary XDH nucleotide sequences may also be found in SEQ ID NOs:1, 3, 5, 7, 9, 11, and 15. SEQ ID NOs:2, 4, 6, 8, 10, 12, and 16 are the antisense sequences of SEQ ID NOs: 1, 3, 5, 7, 9, 11, and 15, respectively.

The term "XDH," as used herein, also refers to naturally occurring DNA sequence variations of the XDH gene. The term"XDH," as used herein, also refers to single nucleotide polymorphisms in the XDH gene. Numerous sequence variations within the XDH gene have been identified and may be found at, for example, NCBI dbSNP and UniProt (see, e.g., www.ncbi.nlm.nih.gov/snp?LinkName=gene_snp&from_uid=7498 (which is incorporated herein by reference as of the date of filing this application) which lists over 3000 SNPs in human XDH). In certain embodiments, such naturally occurring variants are included within the scope of the XDH gene sequence.

Further information on XDH can be found, for example, at www.ncbi.nlm.nih.gov/gene/7498 (which is incorporated herein by reference as of the date of filing this application).

Additional examples of XDH mRNA sequences are readily available through publicly available databases, e.g., GenBank, UniProt, OMIM, and the *Macaca* genome project web site.

The entire contents of each of the foregoing GenBank Accession numbers and the Gene database numbers are incorporated herein by reference as of the date of filing this application.

As used herein, "target sequence" refers to a contiguous portion of the nucleotide sequence of an mRNA molecule formed during the transcription of a xanthine dehydrogenase gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of an XDH gene. In one embodiment, the target sequence is within the protein coding region of XDH.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a xanthine dehydrogenase gene in a cell, e.g., a cell within a subject, such as a mammalian subject.

In one embodiment, an RNAi agent of the invention includes a single stranded RNA that interacts with a target RNA sequence, e.g., a xanthine dehydrogenase target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a xanthine dehydrogenase (XDH) gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) Cell 150:883-894, the entire contents of each of which are hereby incorporated herein by reference. Any of the antisense nucleotide sequences described herein may be used as a single-stranded siRNA as described herein or as chemically modified by the methods described in Lima et al., (2012) Cell 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a xanthine dehydrogenase (XDH) gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, 5, 6, 7, 8, 9, 10, 20, 23 or more unpaired nucleotides. In some embodiments, the hairpin loop can be 10 or fewer nucleotides.

In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

In certain embodiment, the two strands of double-stranded oligomeric compound can be linked together. The two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. The two strands can be linked together by an oligonucleotide linker including, but not limited to, (N)n; wherein N is independently a modified or unmodified nucleotide and n is 3-23. In some embodiments, n is 3-10, e.g., 3, 4, 5, 6, 7, 8, 9, or 10. In some embodiments, the oligonucleotide linker is selected from the group consisting of GNRA, (G)4, (U)4, and (dT)4, wherein N is a modified or unmodified nucleotide and R is a modified or unmodified purine nucleotide. Some of the nucleotides in the linker can be involved in base-pair interactions with other nucleotides in the linker. The two strands can also be linked together by a non-nucleoside linker, e.g. a linker described herein. It will be appreciated by one of skill in the art that any oligonucleotide chemical modifications or variations describe herein can be used in the oligonucleotide linker.

Hairpin and dumbbell type oligomeric compounds will have a duplex region equal to or at least 14, 15, 15, 16, 17, 18, 19, 29, 21, 22, 23, 24, or 25 nucleotide pairs. The duplex region can be equal to or less than 200, 100, or 50, in length. In some embodiments, ranges for the duplex region are 15-30, 17 to 23, 19 to 23, and 19 to 21 nucleotides pairs in length.

The hairpin oligomeric compounds can have a single strand overhang or terminal unpaired region, in some embodiments at the 3', and in some embodiments on the antisense side of the hairpin. In some embodiments, the overhangs are 1-4, more generally 2-3 nucleotides in length. The hairpin oligomeric compounds that can induce RNA interference are also referred to as "shRNA" herein.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., a xanthine dehydrogenase (XDH) gene, to direct cleavage of the target RNA.

In some embodiments, an iRNA of the invention is a dsRNA of 24-30 nucleotides that interacts with a target RNA sequence, e.g., an XDH target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., an XDH mRNA.

As used herein, the term "region of complementarity" refers to the region on the antisense strand that is substantially complementary to a sequence, for example a target sequence, e.g., a xanthine dehydrogenase nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, a RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an XDH gene, generally does not contain any mismatch within the central 13 nucleotides. The methods described herein or methods known in the art can be used to determine whether an RNAi agent containing a mismatch to a target sequence is effective in inhibiting the expression of an XDH gene. Consideration of the efficacy of RNAi agents with mismatches in inhibiting expression of an XDH gene is important, especially if the particular region of complementarity in an XDH gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can be, for example, "stringent conditions", where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a xanthine dehydrogenase gene). For example, a polynucleotide is complementary to at least a part of a xanthine dehydrogenase mRNA if the sequence is substantially complementary to a non-interrupted portion of an mRNA encoding a xanthine dehydrogenase gene.

Accordingly, in some embodiments, the antisense polynucleotides disclosed herein are fully complementary to the target XDH sequence.

In other embodiments, the antisense polynucleotides disclosed herein are substantially complementary to the target XDH sequence and comprise a contiguous nucleotide sequence which is at least 80% complementary over its entire length to the equivalent region of the nucleotide sequence of any one of SEQ ID NOs:1, 3, 5, 7, 9, 11, or 15, or a fragment of any one of SEQ ID NOs:1, 3, 5, 7, 9, 11, or 15, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target XDH sequence and comprise a contiguous nucleotide sequence which is at least about 80% complementary over its entire length to any one of the sense strand nucleotide sequences in any one of Tables 2-3 and 6-7, or a fragment of any one of the sense strand nucleotide sequences in any one of Tables 2-3 and 6-7, such as about 85%, about 90%, about 95%, or fully complementary.

In some embodiments, the antisense polynucleotides disclosed herein are substantially complementary to the target XDH sequence and comprise a contiguous nucleotide sequence which is at least about 80% complementary over its entire length to a fragment of SEQ ID NO:1 selected from the group of nucleotides 226-269; 1318-1352; 1953-1998; 2351-2394; 2679-2730; 3867-3916; or 4510-4574 of SEQ ID NO: 1, such as about 85%, about 90%, about 95%, or fully complementary.

In some embodiments, the antisense polynucleotides disclosed herein are substantially complementary to the target XDH sequence and comprise a contiguous nucleotide sequence which is at least about 80% complementary over its entire length to a fragment of SEQ ID NO:1 selected from the group of nucleotides 15-45; 121-162; 226-292; 306-338; 379-402; 428-458; 495-521; 873-907; 1318-1344; 1381-1407; 1604-1643; 1700-1723; 1960-1991; 1996-2029; 2044-2067; 2128-2174; 2186-2208; 2289-2345; 2359-2419;

2689-2722; 2699-2721; 2774-2797; 2930-2958; 2987-3064; 3083-3158; 3195-3221; 3248-3293; 3352-3405; 3460-3520; 3524-3571; 3575-3644; 3870-3963; 4143-4176; 4259-4315; 4355-4379; 4395-4467; 4502-4562; 4577-4648; 4658-4752; 4815-4854; 5199-5277; 5284-5310; 5358-5446; or 5677-5713 of SEQ ID NO: 1, such as about 85%, about 90%, about 95%, or fully complementary.

In some embodiments, the antisense polynucleotides disclosed herein are substantially complementary to the target XDH sequence and comprise a contiguous nucleotide sequence which is at least about 80% complementary over its entire length to a fragment of SEQ ID NO:1 selected from the group of nucleotides 123-143; 229-249; 229-251, 230-250; 237-259; 241-263; 271-291; 1320-1342; 1321-1341; 1965-1987; 1971-1993; 2130-2150; 2682-2704; 2689-2711; 2690-2710; 2699-2721; 3880-3900; or 3883-3903 of SEQ ID NO: 1, such as about 85%, about 90%, about 95%, or fully complementary.

In some embodiments, the antisense polynucleotides disclosed herein are substantially complementary to the target XDH sequence and comprise a contiguous nucleotide sequence which is at least about 80% complementary over its entire length to a fragment of SEQ ID NO:1, e.g., nucleotides 2699-2721 of SEQ ID NO:1, such as about 85%, about 90%, about 95%, or fully complementary.

In one embodiment, an RNAi agent of the disclosure includes a sense strand that is substantially complementary to an antisense polynucleotide which, in turn, is the same as a target XDH sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, 10, 12, or 16, or a fragment of any one of SEQ ID NOs:2, 4, 6, 8, 10, 12, or 16, such as about 85%, about 90%, about 95%, or fully complementary.

In some embodiments, an RNAi agent of the invention includes a sense strand that is substantially complementary to an antisense polynucleotide which, in turn, is complementary to a target xanthine dehydrogenase sequence, and wherein the sense strand polynucleotide comprises a contiguous nucleotide sequence which is at least about 80% complementary over its entire length to any one of the antisense strand nucleotide sequences in any one of Tables 2-3 and 6-7, or a fragment of any one of the antisense strand nucleotide sequences in any one of Tables 2-3 and 6-7, such as about 85%, about 90%, about 95%, or fully complementary.

In some embodiments, the double-stranded region of a double-stranded iRNA agent is equal to or at least, 17, 18, 19, 20, 21, 22, 23, 23, 24, 25, 26, 27, 28, 29, 30 or more nucleotide pairs in length.

In some embodiments, the antisense strand of a double-stranded iRNA agent is equal to or at least 17, 18, 19, 20, 21, 22, 23, 23, 24, 25, 26, 27, 28, 29, or 30 nucleotides in length.

In some embodiments, the sense strand of a double-stranded iRNA agent is equal to or at least 17, 18, 19, 20, 21, 22, 23, 23, 24, 25, 26, 27, 28, 29, or 30 nucleotides in length.

In one embodiment, the sense and antisense strands of the double-stranded iRNA agent are each 18 to 30 nucleotides in length.

In one embodiment, the sense and antisense strands of the double-stranded iRNA agent are each 19 to 25 nucleotides in length.

In one embodiment, the sense and antisense strands of the double-stranded iRNA agent are each 21 to 23 nucleotides in length.

In one embodiment, the sense strand of the iRNA agent is 21-nucleotides in length, and the antisense strand is 23-nucleotides in length, wherein the strands form a double-stranded region of 21 consecutive base pairs having a 2-nucleotide long single stranded overhangs at the 3'-end.

In some embodiments, the majority of nucleotides of each strand are ribonucleotides, but as described in detail herein, each or both strands can also include one or more non-ribonucleotides, e.g., a deoxyribonucleotide or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In one embodiment, at least partial suppression of the expression of an XDH gene, is assessed by a reduction of the amount of XDH mRNA which can be isolated from or detected in a first cell or group of cells in which an XDH gene is transcribed and which has or have been treated such that the expression of an XDH gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858, 225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a rabbit, a sheep, a hamster, a guinea pig, a dog, a rat, or a mouse), or a bird that expresses the target gene, either endogenously or heterologously. In an embodiment, the subject is a human, such as a human being treated or assessed for a disease or disorder that would benefit from reduction in XDH expression; a human at risk for a disease or disorder that would benefit from reduction in XDH expression; a human having a disease or disorder that would benefit from reduction in XDH expression; or human being treated for a disease or disorder that would benefit from reduction in XDH expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of an XDH-associated disorder in a subject. Treatment also includes a reduction of one or more sign or symptoms associated with unwanted XDH expression; diminishing the extent of unwanted XDH activation or stabilization; amelioration or palliation of unwanted XDH activation or stabilization. "Treatment" can also mean prolonging survival as compared to expected survival in the absence of treatment.

The term "lower" in the context of the level of XDH in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of XDH in a subject is a decrease to a level accepted as within the range of normal for an individual without such disorder. In certain embodiments, the expression of the target is normalized, i.e., decreased towards or to a level accepted as within the range of normal for an individual without such disorder, e.g., normalization of serum uric acid level. As used here, "lower" in a subject can refer to lowering of gene expression or protein production in a cell in a subject does not require lowering of expression in all cells or tissues of a subject. For example, as used herein, lowering in a subject can include lowering of gene expression or protein production in the liver of a subject.

The term "lower" can also be used in association with normalizing a symptom of a disease or condition, i.e. decreasing the difference between a level in a subject suffering from an XDH-associated disease towards or to a level in a normal subject not suffering from an XDH-associated disease.

As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder or condition thereof, that would benefit from a reduction in expression of an XDH gene or production of XDH protein, refers to preventing a subject who has at least one sign or symptom of a disease from developing further signs and symptoms thereby meeting the diagnostic criteria for that disease. In certain embodiments, prevention includes delayed progression to meeting the diagnostic criteria of the disease by days, weeks, months or years as compared to what would be predicted by natural history studies or the typical progression of the disease.

As used herein, the terms "xanthine dehydrogenase-associated disease" or "XDH-associated disease," include a disease, disorder or condition that would benefit from a decrease in XDH gene expression, replication, or protein activity. Such disorders are caused by, or associated with elevated serum uric acid levels, such as hyperuricemia, including asymptomatic hyperuricemia.

"Hyperuricemia" is an elevated uric acid level in the blood. The normal upper limit is 6.8 mg/dL, and anything over 7 mg/dL is considered saturated, and symptoms can occur. Additional indicators of hyperuricemia include, for example, accelerated purine degradation, in high cell turn-over states (hemolysis, rhabdomyolysis, and tumor lysis) and decreased excretion (renal insufficiency and metabolic acidosis). Methods to detect and monitor uric acid in serum or other subject samples are known in the art. Uric acid levels can be detected, for example using carbonate-phosphotungstate method, spectrophotometric uricase method, or chromatography methods such as HPLC or LCMS.

Hyperuricemia is associated with a number of diseases and conditions, including, but not limited to, gout NAFLD, NASH, metabolic disorder, insulin resistance, cardiovascular disease, hypertension, type 2 diabetes, and conditions linked to oxidative stress e.g., chronic low grade inflammation; or other XDH-associated disease. Thus, the compositions and methods of the invention which lower serum urine acid levels, e.g., lower serum uric acid levels to about to 6.8 mg/dl or less (the level of solubility of uric acid in serum) are also useful to treat subjects having gout, NAFLD, NASH, metabolic disorder, insulin resistance, cardiovascular disease, hypertension, type 2 diabetes, or conditions linked to oxidative, even in the absence of symptoms "Gout" is a disorder that allows for the accumulation of uric acid in the blood and tissues. This leads to the precipitation of urate monohydrate crystals within a joint. When tissues are saturated with urate, crystals will precipitate. Precipitation is enhanced in acidic environments and cold environments, leading to increased precipitation in peripheral joints, such as the great toe. Gout has a male predominance in a 4:1 ratio of men to women. Uric acid levels can be elevated ten to 15 years before clinical manifestations of gout.

NAFLD is associated with hyperuricemia (Xu et al., J. Hepatol. 62:1412-1419, 2015). The diagnosis of "nonalcoholic fatty liver disease" ("NAFLD") requires that (a) there is evidence of hepatic steatosis, either by imaging or by histology and (b) there are no causes for secondary hepatic fat accumulation such as significant alcohol consumption, use of steatogenic medication or hereditary disorders. In the majority of patients, NAFLD is associated with metabolic risk factors such as obesity, diabetes mellitus, and dyslipidemia. NAFLD is histologically further categorized into "nonalcoholic fatty liver" ("NAFL") and "nonalcoholic steatohepatitis" ("NASH"). "NAFL" is defined as the presence of hepatic steatosis with no evidence of hepatocellular injury in the form of ballooning of the hepatocytes. "NASH" is defined as the presence of hepatic steatosis and inflammation with hepatocyte injury (ballooning) with or without fibrosis (Chalasani et al., Hepatol. 55:2005-2023, 2012). It is generally agreed that patients with simple steatosis have very slow, if any, histological progression, while patients with NASH can exhibit histological progression to cirrhotic-stage disease. The long term outcomes of patients with NAFLD and NASH have been reported in several studies. Their findings can be summarized as follows; (a) patients with NAFLD have increased overall mortality compared to matched control populations, (b) the most common cause of death in patients with NAFLD, NAFL, and NASH is cardiovascular disease, and (c) patients with NASH (but not NAFL) have an increased liver-related mortality rate. In a mouse model of NAFLD, treatment with allopurinol both prevented the development of hepatic steatosis, but also significantly ameliorated established hepatic steatosis in mice (Xu et al., J. Hepatol. 62:1412-1419, 2015).

Cardiovascular disease has been associated with hyperuricemia. Allopurinol has been demonstrated to be effective in the treatment of cardiovascular disease in animal models and humans including myocardial infarction, ischemia-reperfusion injury, hypoxia, ischemic heart disease, heart failure, hypercholesterolemia, and hypertension (Pacher et al., Pharma. Rev. 58:87-114, 2006). As discussed above, treatment with allopurinol is contraindicated in a number of populations, especially those with compromised renal function.

Metabolic syndrome, insulin resistance, and type 2 diabetes are associated with hyperuricemia (Cardoso et al., J. Pediatr. 89:412-418, 2013).

"Metabolic syndrome" is characterized by a cluster of conditions defined as at least three of the five following metabolic risk factors which include:large waistline (≥35 inches for women or ≥40 inches for men); high triglyceride level (≥150 mg/dl); low HDL cholesterol (≤50 mg/dl for women or ≤40 mg/dl for men); elevated blood pressure (≥130/85) or on medicine to treat high blood pressure; and high fasting blood sugar (≥100 mg/dl) or being in medicine to treat high blood sugar.

"Insulin resistance" is characterized by the presence of at least one of: a fasting blood glucose level of 100-125 mg/dL taken at two different times; or an oral glucose tolerance test with a result of a glucose level of 140-199 mg/dL at 2 hours after glucose consumption.

"Type 2 diabetes" is characterized by at least one of: a fasting blood glucose level ≥126 mg/dL taken at two different times; ahemoglobin A1c (A1C) test with a result of ≥6.5% or higher; or an oral glucose tolerance test with a result of a glucose level ≥200 mg/dL at 2 hours after glucose consumption.
Metabolic syndrome, insulin resistance, and type 2 diabetes are often associated with decreased renal function or the potential for decreased renal function.

Further details regarding signs and symptoms of the various diseases or conditions are provided herein and are well known in the art.

In one embodiment of the invention, the XDH-associated disease is hyperuricemia.

In another embodiment of the invention, the XDH-associate disease is gout.

In certain embodiments, an XDH-associated disease is NASH or NAFLD.

"Therapeutically effective amount," as used herein, is intended to include the amount of an RNAi agent that, when administered to a subject having an XDH-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated. In certain embodiments, treatment with the iRNAs of the invention will result in serum uric acid levels at 2-6.8 mg/dl, such as, 2-6 mg/dl in subjects. Maintenance of such uric acid levels will treat or prevent XDH-associated diseases.

"Prophylactically effective amount," as used herein, is intended to include the amount of an RNAi agent that, when administered to a subject having at least one sign or symptom of an XDH-associated disorder, is sufficient to prevent or delay the subject's progression to meeting the full diagnostic criteria of the disease. Prevention of the disease includes slowing the course of progression to full blown disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a xanthine dehydrogenase gene. In some embodiments, the iRNA includes double stranded ribonucleic acid (dsRNA) molecules for inhibiting the expression of an XDH gene in a cell, such as a cell within a subject, e.g., a mammal, such as a human susceptible to developing a xanthine dehydrogenase-associated disorder. The dsRNAi agent includes an antisense strand having a region of complementarity which is complementary to at least a part of an mRNA formed in the expression of an XDH gene. The region of complementarity is about 19-30 nucleotides in length (e.g., about 30, 29, 28, 27, 26, 25, 24, 23, 22, 21, 20, or 19 nucleotides in length). Upon contact with a cell expressing the XDH gene, the iRNA inhibits the expression of the XDH gene (e.g., a human, a primate, a non-primate, or a rat XDH gene) by at least about 50% as assayed by, for example, a PCR or branched DNA (bDNA)-based method, or by a protein-based method, such as by immunofluorescence analysis, using, for example, western blotting or flow cytometric techniques. In some embodiments, inhibition of expression is determined by the qPCR method provided in the examples herein with the siRNA at, e.g., a 10 nM concentration, in an appropriate organism cell or cell line provided therein. In some embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an XDH gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target xanthine dehydrogenase gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

Regardless of the method of synthesis, the siRNA preparation can be prepared in a solution (e.g., an aqueous or organic solution) that is appropriate for formulation. For example, the siRNA preparation can be precipitated and redissolved in pure double-distilled water, and lyophilized. The dried siRNA can then be resuspended in a solution appropriate for the intended formulation process.

In an aspect, a dsRNA of the invention includes at least two nucleotide sequences, a sense sequence and an antisense sequence. The sense strand is selected from the group of sequences provided in any one of Tables 2-3 and 6-7, and the corresponding antisense strand of the sense strand is selected from the group of sequences of any one of Tables 2-3 and 6-7. In this aspect, one of the two sequences is complementary to the other of the two sequences, with one of the sequences being substantially complementary to a sequence of an mRNA generated in the expression of a xanthine dehydrogenase gene. As such, in this aspect, a dsRNA will include two oligonucleotides, where one oligonucleotide is described as the sense strand in any one of Tables 2-3 and 6-7, and the second oligonucleotide is described as the corresponding antisense strand of the sense strand in any one of Tables 2-3 and 6-7.

In certain embodiments, the substantially complementary sequences of the dsRNA are contained on separate oligonucleotides. In other embodiments, the substantially complementary sequences of the dsRNA are contained on a single oligonucleotide.

It will be understood that, although the sequences in Tables 2 and 6 are not described as modified or conjugated sequences, the RNA of the iRNA of the invention e.g., a dsRNA of the invention, may comprise any one of the sequences set forth in any one of Tables 2-3 and 6-7 that is un-modified, un-conjugated, or modified or conjugated differently than described therein. In other words, the invention encompasses dsRNA of Tables 2-3 and 6-7 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-3 and 6-7, dsRNAs described herein can include at least one strand of a length of minimally 21 nucleotides. It can be reasonably expected that shorter duplexes having any one of the sequences in any one of Tables 2-3 and 6-7 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-3 and 6-7, and differing in their ability to inhibit the expression of a xanthine dehydrogenase gene by not more than about 5, 10, 15, 20, 25, or 30% inhibition from a dsRNA comprising the full sequence, are contemplated to be within the scope of the present invention.

In addition, the RNAs provided in Tables 2-3 and 6-7 identify a site(s) in a xanthine dehydrogenase transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-3 and 6-7 coupled to additional nucleotide sequences taken from the region contiguous to the selected sequence in a xanthine dehydrogenase gene.

An RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an XDH gene generally does not contain any mismatch within the central 13 nucleotides. The methods described herein or methods known in the art can be used to determine whether an RNAi agent containing a mismatch to a target sequence is effective in inhibiting the expression of an XDH gene. Consideration of the efficacy of RNAi agents with mismatches in inhibiting expression of an XDH gene is important, especially if the particular region of complementarity in an XDH gene is known to have polymorphic sequence variation within the population.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester or phosphorothioate groups present in the agent. Agents in which substantially all of the phosphodiester or phosphorothioate linkages have a sodium counterion include not more than 5, 4, 3, 2, or 1 phosphodiester or phosphorothioate linkages without a sodium counterion. In some embodiments, when the dsRNA agents of the invention are in the sodium salt form, sodium ions are present in the agent as counterions for all of the phosphodiester or phosphorothiotate groups present in the agent.

Representative U.S. Patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6, 239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. Patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—OCH2-.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$).$_n$OCH$_3$, O($CH_2$)$_n$NH$_2$, O($CH_2$)$_n$CH$_3$, O($CH_2$)$_n$ONH$_2$, and O($CH_2$)$_n$ON[($CH_2$)$_n$CH$_3$)]2, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethyl (also known in the art as 2'-O-dimethylaminoethoxyethyl or 2'-DMAEOE), i.e., 2'-O—CH$_2$—O—CH$_2$—N(CH$_3$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine.

5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. Patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An iRNA agent of the disclosure can also be modified to include one or more bicyclic sugar moieties. A "bicyclic sugar" is a furanosyl ring modified by a ring formed by the bridging of two carbons, whether adjacent or non-adjacent. A "bicyclic nucleoside" ("BNA") is a nucleoside having a sugar moiety comprising a ring formed by bridging two carbons, whether adjacent or non-adjacent, of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

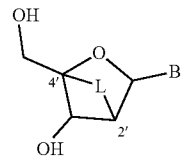

wherein B is a nucleobase or modified nucleobase and L is the linking group that joins the 2'-carbon to the 4'-carbon of the ribose ring.

Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH (CH$_2$OCH$_3$)—O-2' (and analogs thereof; see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N(OCH$_3$)-2' (and analogs thereof; see e.g., U.S. Pat. No. 8,278,425); 4'-CH$_2$—O—N(CH$_3$)-2' (see, e.g., U.S. Patent Publication No. 2004/0171570); 4'-CH$_2$—N(R)—O-2', wherein R is H, C1-C12 alkyl, or a nitrogen protecting group (see, e.g., U.S. Pat. No. 7,427,672); 4'-CH$_2$—C(H)(CH$_3$)-2' (see, e.g., Chattopadhyaya et al., J. Org. Chem., 2009, 74, 118-134); and 4'-CH$_2$—C(H$_2$)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US2013/0190383; and WO2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see Nuc. Acids Symp. Series, 52, 133-134 (2008) and Fluiter et al., Mol. Biosyst., 2009, 10, 1039 hereby incorporated by reference).

Representative U.S. publications that teach the preparation of UNA include, but are not limited to, U.S. Pat. No. 8,314,227; and US2013/0096289; US2013/0011922; and US2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in WO2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example US2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., XDH gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, and 9 from the 5'end. The antisense strand contains at least one motif of three 2'-O-methyl modifications on three consecutive nucleotides at positions 11, 12, and 13 from the 5'end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5' end. The antisense strand contains at least one motif of three 2'-O-methyl modifications on three consecutive nucleotides at positions 11, 12, and 13 from the 5' end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-O-methyl modifications on three consecutive nucleotides at positions 11, 12, and 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5'end; the antisense strand contains at least one motif of three 2'-O-methyl modifications on three consecutive nucleotides at positions 11, 12, and 13 from the 5'end, wherein one end of the RNAi agent is blunt, while the other end comprises a 2 nucleotide overhang. In some embodiments, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (such as, GalNAc).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, and 13 from the 5' end; wherein the 3' end of the first strand and the 5' end of the second strand form a blunt end and the second strand is 1~4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, and 11 positions; the 10, 11, and 12 positions; the 11, 12, and 13 positions; the 12, 13, and 14 positions; or the 13, 14, and 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

 (I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;

wherein $N_b$ and Y do not have the same modification; and XXX, YYY, and ZZZ each independently represent one motif of three identical modifications on three consecutive nucleotides. In some embodiments, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

 (Ib);

 (Ic); or

 (Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In some embodiments, $N_b$ is 0, 1, 2, 3, 4, 5, or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

 (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

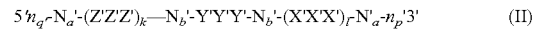 (II)

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;

wherein $N_b'$ and Y' do not have the same modification; and

X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In some embodiments, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

$$5'n_q\text{-}N_a'\text{-}Z'Z'Z'\text{-}N_b'\text{-}Y'Y'Y'\text{-}N_a'\text{-}n_p,3' \quad \text{(IIb)};$$

$$5'n_q'\text{-}N_a'\text{-}Y'Y'Y'\text{-}N_b'\text{-}X'X'X'\text{-}n_p'3' \quad \text{(IIc); or}$$

$$5'n_q\text{-}N_a'\text{-}Z'Z'Z'\text{-}N_b'\text{-}Y'Y'Y'\text{-}N_b'\text{-}X'X'X'\text{-}N_a'\text{-}n_p3' \quad \text{(IId)}.$$

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In some embodiments, $N_b$ is 0, 1, 2, 3, 4, 5, or 6.

In other embodiments, k is 0 and l is 0 and the antisense strand may be represented by the formula:

$$5'n_p\text{-}N_a\text{-}Y'Y'Y'\text{-}N_a\text{-}n_q3' \quad \text{(Ia)}.$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense: $5'n_p\text{-}N_a\text{-}(XXX)_i\text{-}N_b\text{-}YYY\text{-}N_b\text{-}(ZZZ)_j\text{-}N_a\text{-}n_q3'$ antisense: $3'n_p'\text{-}N_a'\text{-}(X'X'X')_k\text{-}N_b'\text{-}Y'Y'Y'\text{-}N_b'\text{-}(Z'Z'Z')_l\text{-}N_a'\text{-}n_q'5'$ (III)

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

$5'n_p\text{-}N_a\text{-}YYY\text{-}N_a\text{-}n_q3'$ $3'n_p'\text{-}N_a'\text{-}Y'Y'Y'\text{-}N_a'n_q'5'$ (IIIa)

$5'n_p\text{-}N_a\text{-}YYY\text{-}N_b\text{-}ZZZ\text{-}N_a\text{-}n_q3'$ $3'n_p'\text{-}N_a'\text{-}Y'Y'Y'\text{-}N_b'\text{-}Z'Z'Z'\text{-}N_a'n_q'5'$ (IIIb)

$5'n_p\text{-}N_a\text{-}XXX\text{-}N_b\text{-}YYY\text{-}N_a\text{-}n_q3'$ $3'n_p'\text{-}N_a'\text{-}X'X'X'\text{-}N_b'\text{-}Y'Y'Y'\text{-}N_a'\text{-}n_q'5'$ (IIIc)

$5'n_p\text{-}N_a\text{-}XXX\text{-}N_b\text{-}YYY\text{-}N_b\text{-}ZZZ\text{-}N_a\text{-}n_q3'$ $3'n_p'\text{-}N_a'\text{-}X^1X^1X^1\text{-}N_b'\text{-}Y^1Y^1Y^1\text{-}N_b'\text{-}Z^1Z^1Z^1\text{-}N_a'\text{-}n_q'5'$ (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$; independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5'-vinyl phosphonate modified nucleotide of the disclosure has the structure:

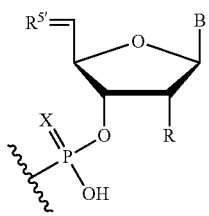

wherein X is O or S;

R is hydrogen, hydroxy, fluoro, or $C_{1-20}$alkoxy (e.g., methoxy or n-hexadecyloxy);

$R^{5'}$ is =C(H)-P(O)(OH)$_2$ and the double bond between the C5' carbon and $R^{5'}$ is in the E or Z orientation (e.g., E orientation); and B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of an iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In some embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In some embodiments, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature (Tm) than the Tm of the dsRNA without having such modification(s). For example, the thermally destabilizing modification(s) can decrease the Tm of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

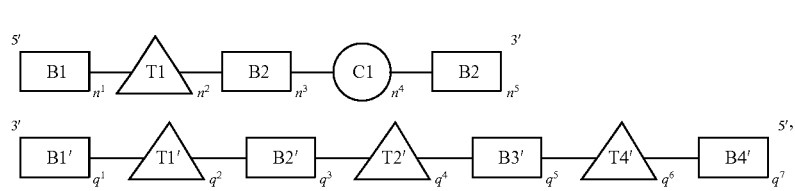

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O-N-methylacetamido (2'-O-NMA, 2'O-CH$_2$C(O)N(Me)H) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

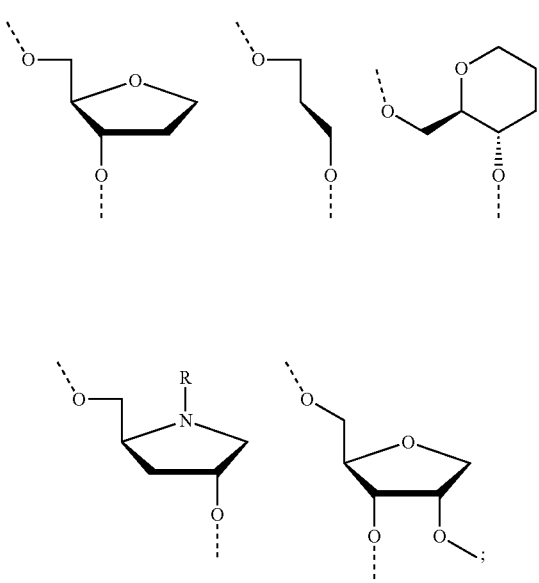

and iii) sugar modification selected from the group consisting of:

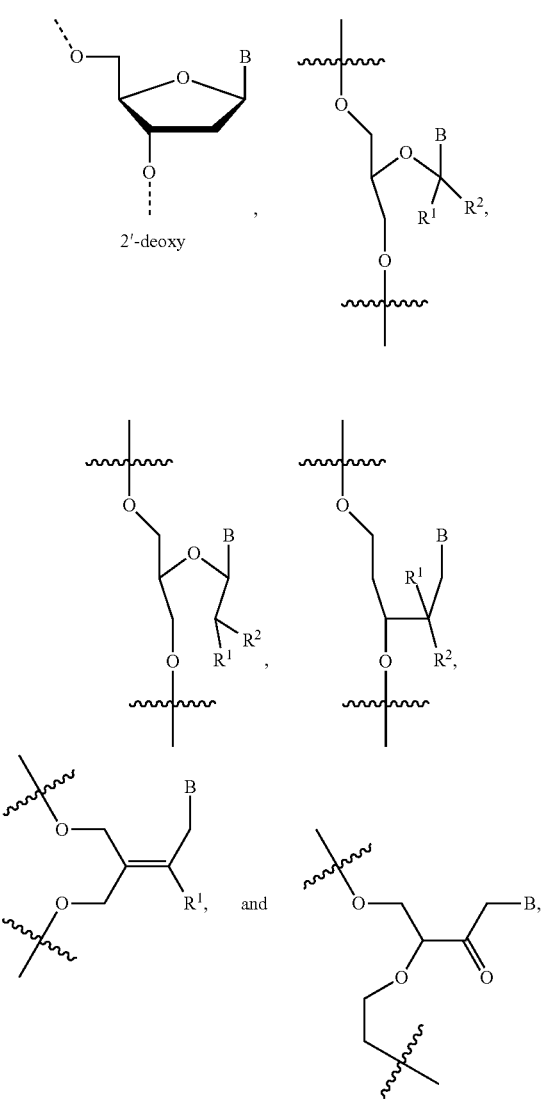

wherein B is a modified or unmodified nucleobase, R$^1$ and R$^2$ independently are H, halogen, OR$_3$, or alkyl; and R3 is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

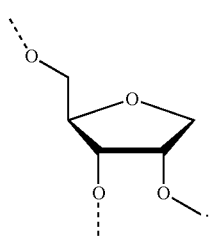

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1. In one embodiment, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 7, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl

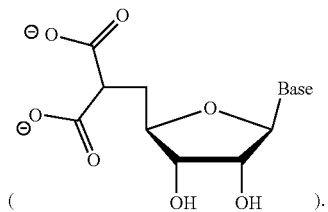

When the 5'-end phosphorus-containing group is 5'-end vinylphosphonate (5'-VP), the 5'-VP can be either 5'-E-VP isomer (i.e., trans-vinylphosphonate,

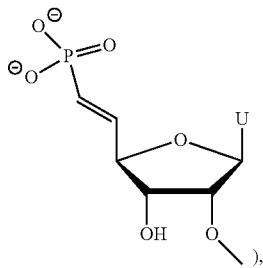

5'-Z-VP isomer (i.e., cis-vinylphosphonate,

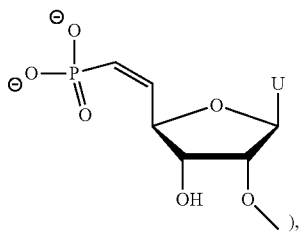

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-$PS_2$. In one embodiment, the RNAi agent comprises a 5'-$PS_2$ in the antisense strand.

In one embodiment, the RNAi agent comprises a 5'-$PS_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker; and
    (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end); and
  (b) an antisense strand having:
    (i) a length of 23 nucleotides;
    (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
    (iii) phosphorothioate internucleotide linkages between nucleotide positions 21 and 22,
  and between nucleotide positions 22 and 23 (counting from the 5' end);
  wherein the dsRNA agents have a two nucleotide overhang at the 3'-end of the antisense strand, and a blunt end at the 5'-end of the antisense strand.

In another particular embodiment, an RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker;
    (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
    (iv) phosphorothioate internucleotide linkages between nucleotide positions 1 and 2, and between nucleotide positions 2 and 3 (counting from the 5' end); and
  (b) an antisense strand having:
    (i) a length of 23 nucleotides;
    (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, 10, 12, 14, and 16 to 21, and 2'-F modifications at positions 7, 9, 11, 13, and 15; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 9, and 12 to 21, and 2'-F modifications at positions 10, and 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-F modifications at positions 1, 3, 5, 7, 9 to 11, and 13, and 2'-OMe modifications at positions 2, 4, 6, 8, 12, and 14 to 21; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end); and (b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end); and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);

wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-3 and 6-7. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA,* 1989, 86: 6553-6556). In other embodiments, the ligand is cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting, or lifetime of an iRNA agent into which it is incorporated. In some embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. In some embodiments, such a lipid or lipid-based molecule binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In some embodiments, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all, such that the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. In some embodiments, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 17). An RFGF analogue (e.g., amino acid sequence AALLPVL-LAAP (SEQ ID NO: 18) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 19) and the *Drosophila* Antennapedia protein (RQIKIWFQNRRMKWKK (SEQ ID NO: 20) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand, e.g., PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference.

In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

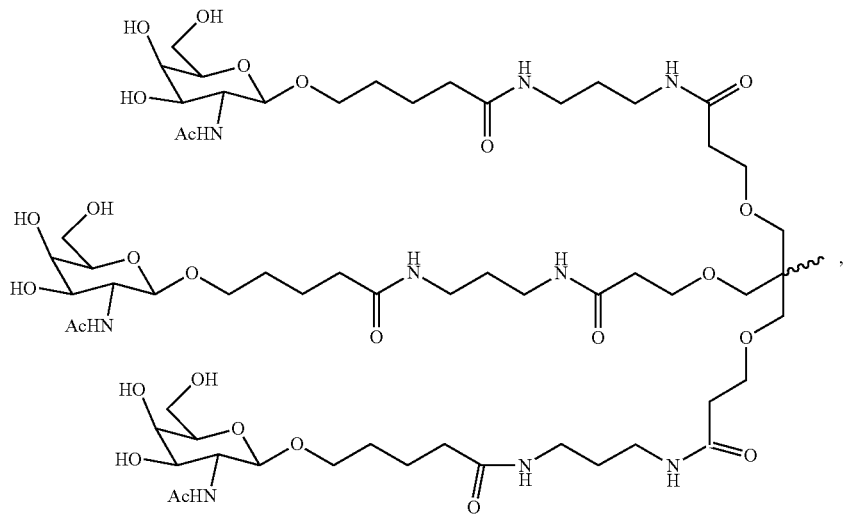

Formula II

-continued
Formula III
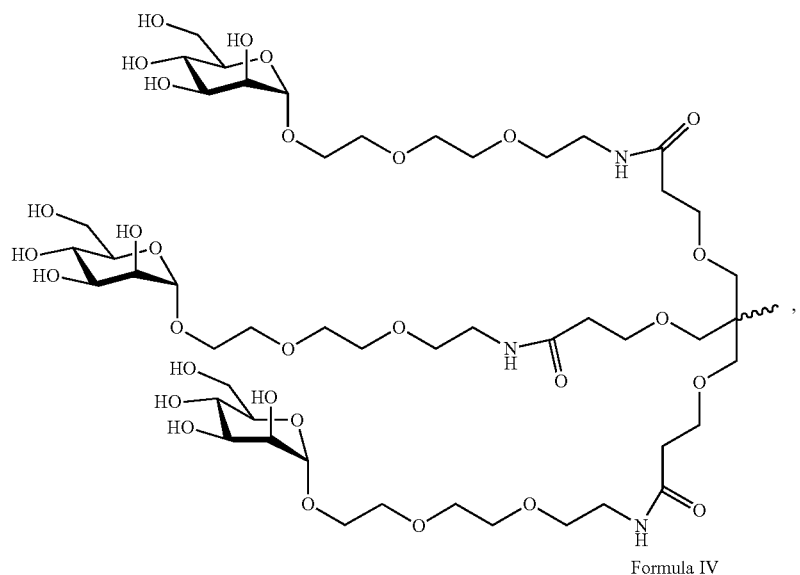
Formula IV
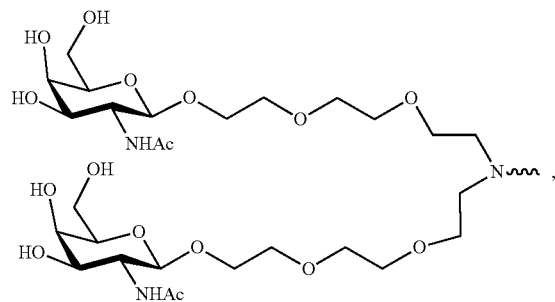
Formula V
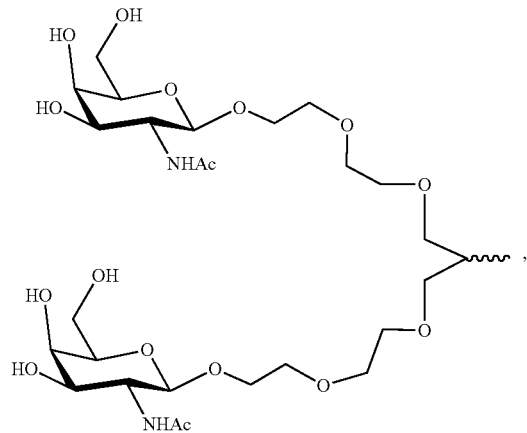
Formula VI
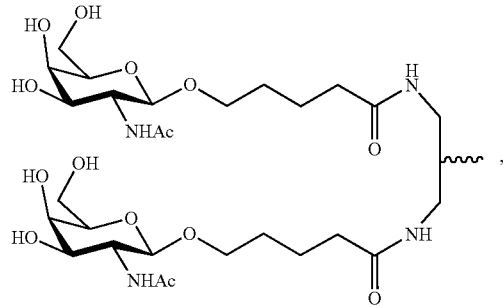

-continued
Formula VII
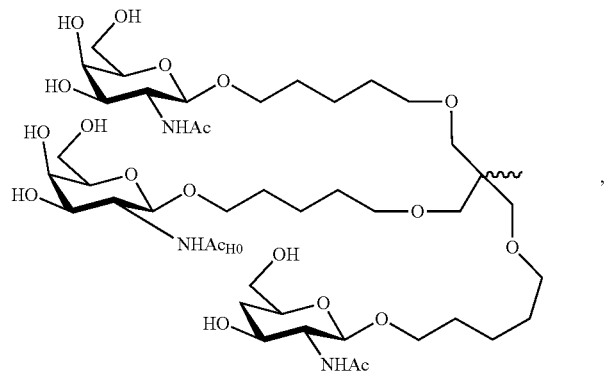
Formula VIII
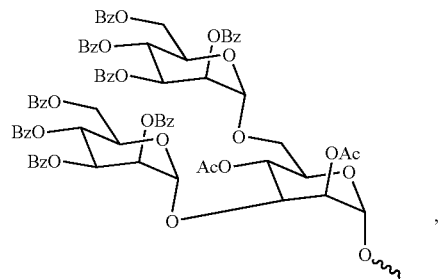
Formula IX
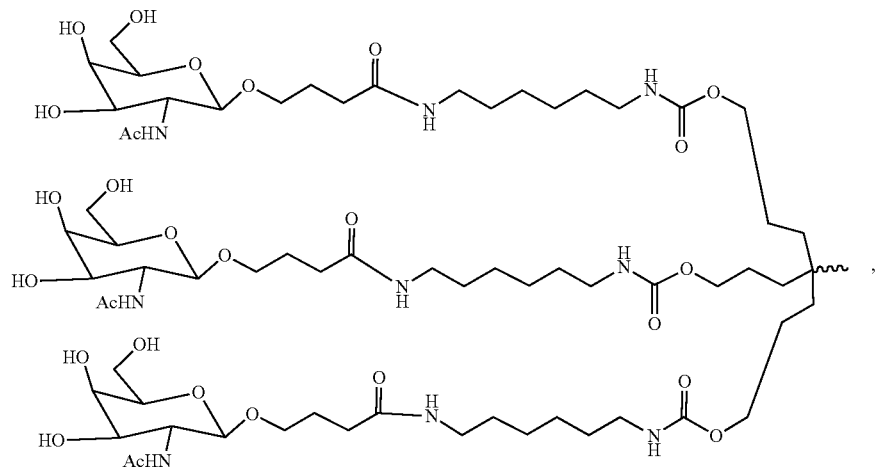
Formula X
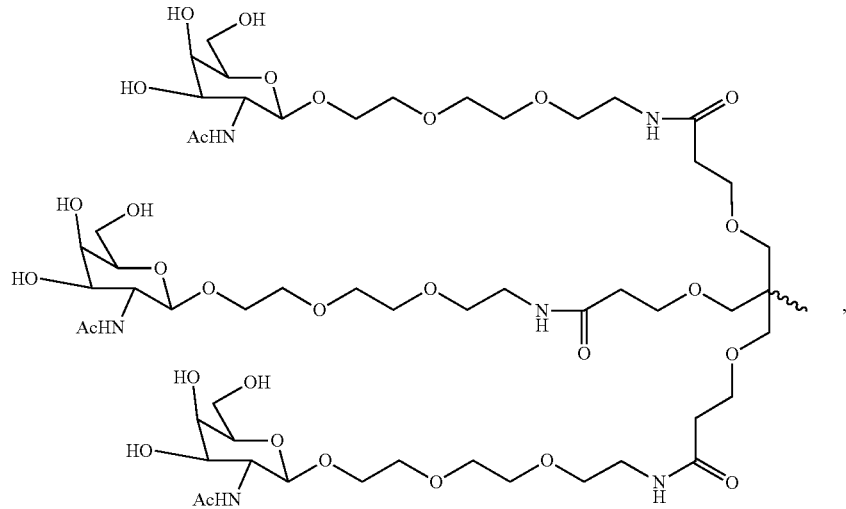

-continued
Formula XI
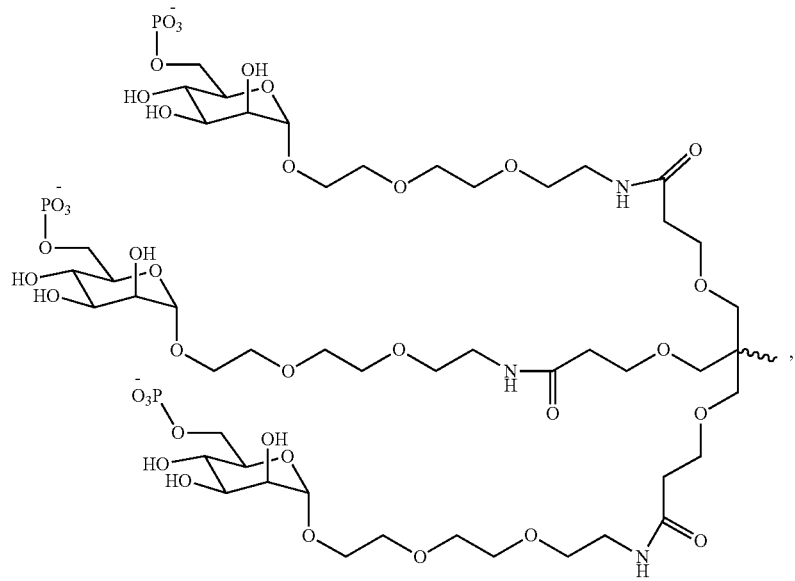
Formula XII
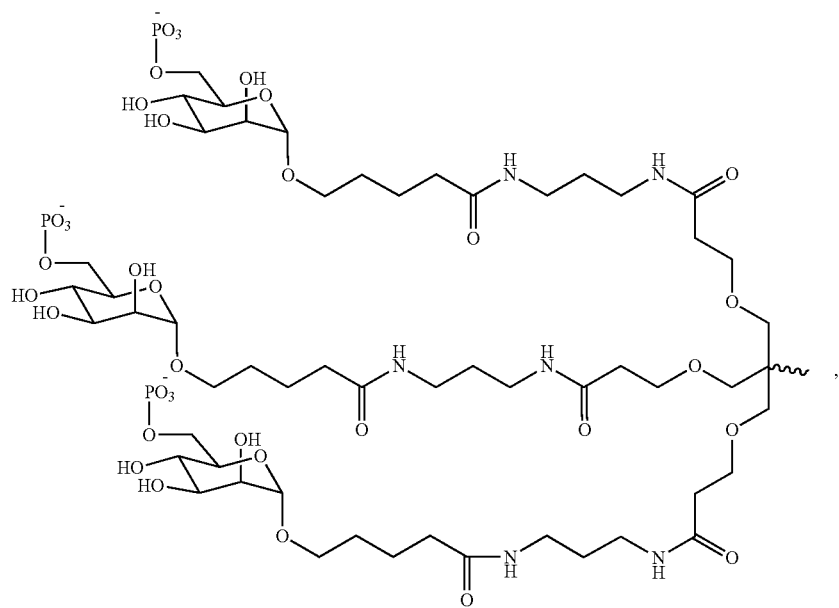
Formula XIII
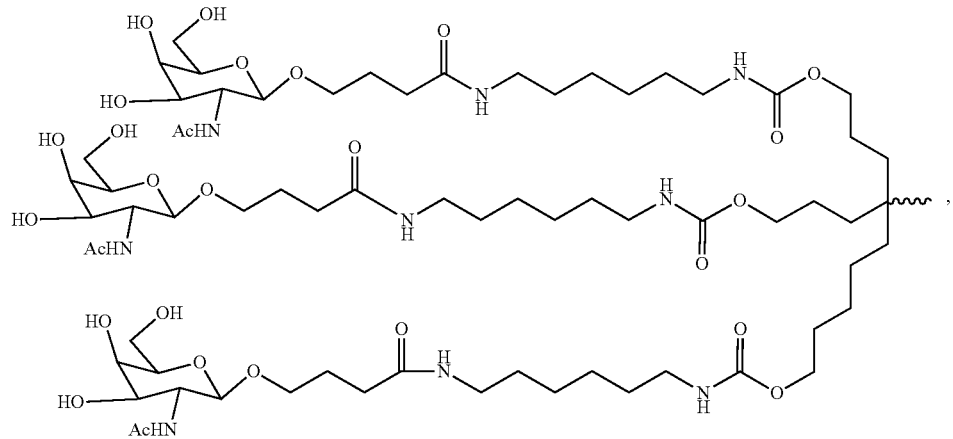

Formula XIV
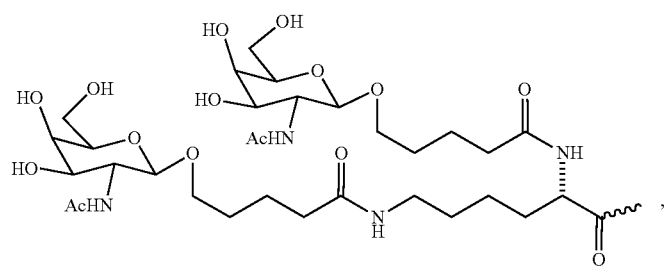
Formula XV
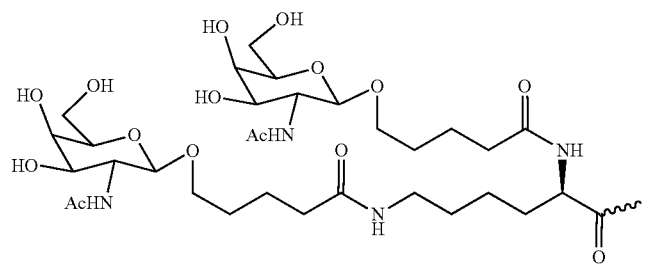
Formula XVI
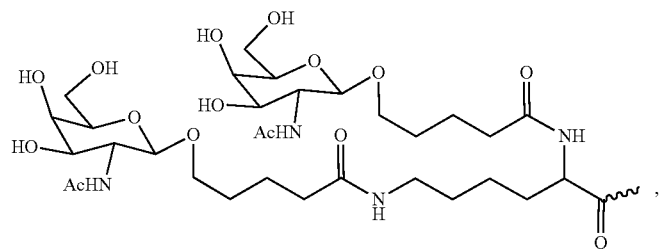
Formula XVII
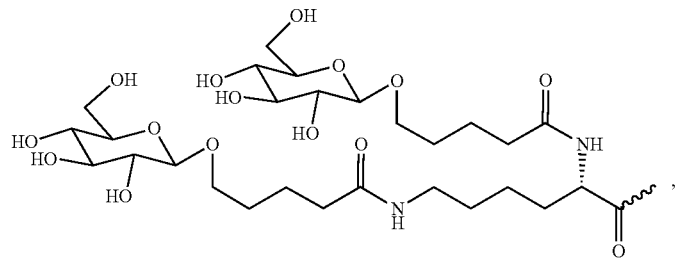
Formula XVIII
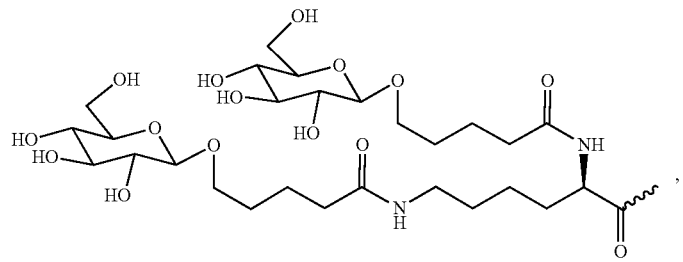
Formula XIX
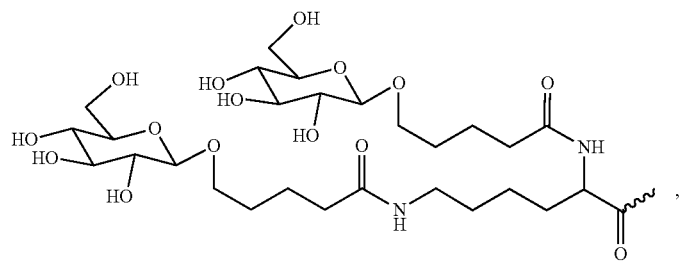

-continued
Formula XX
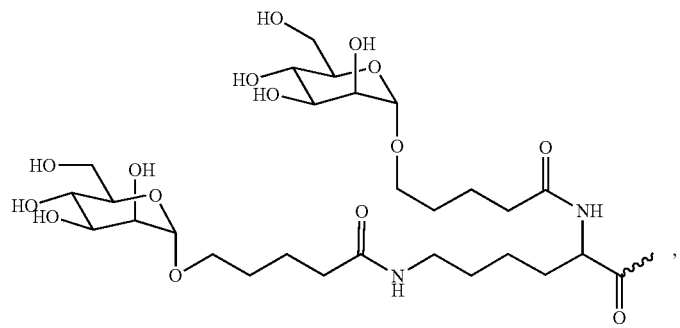
Formula XXI
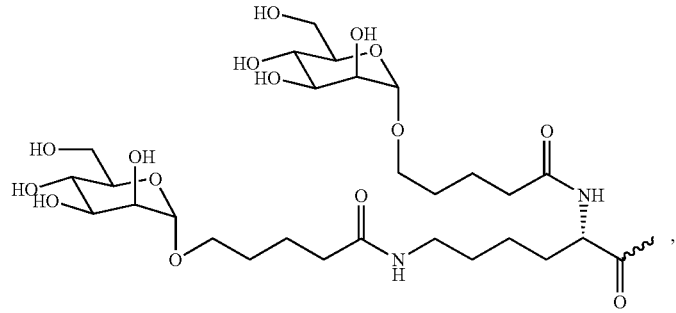
Formula XXII
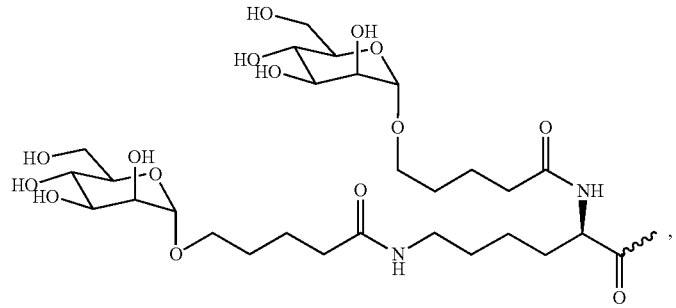
Formula XXIII
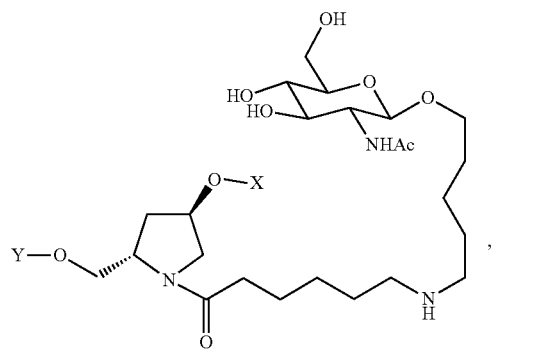
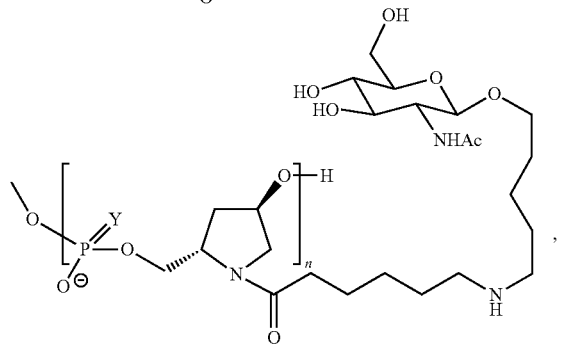

wherein Y is O or S and n is 3-6 (Formula XXIV);
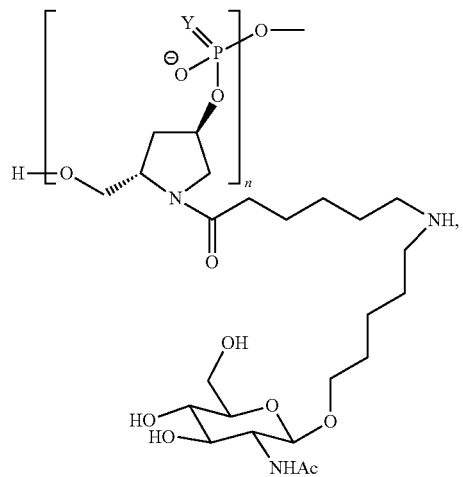
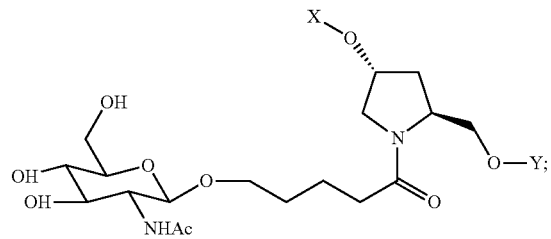
Formula XXVI
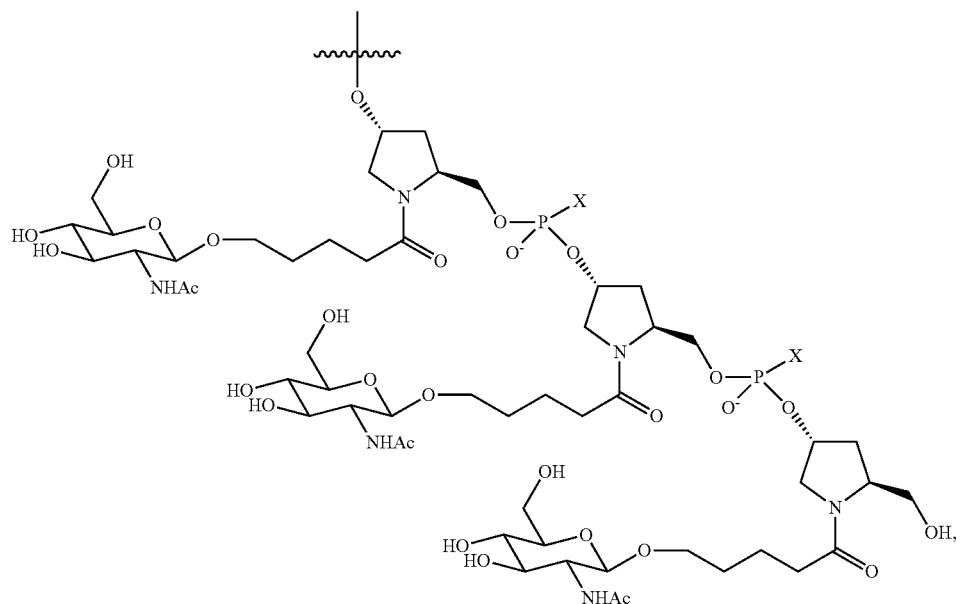
wherein Y is O or S and n is 3-6 (Formula XXV);
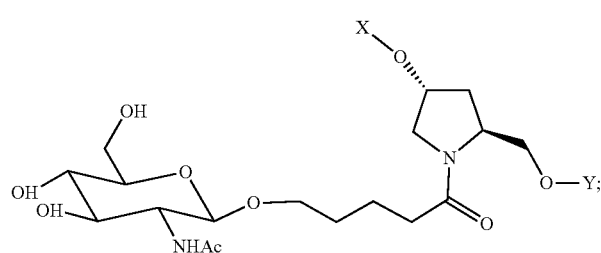
Formula XXVI

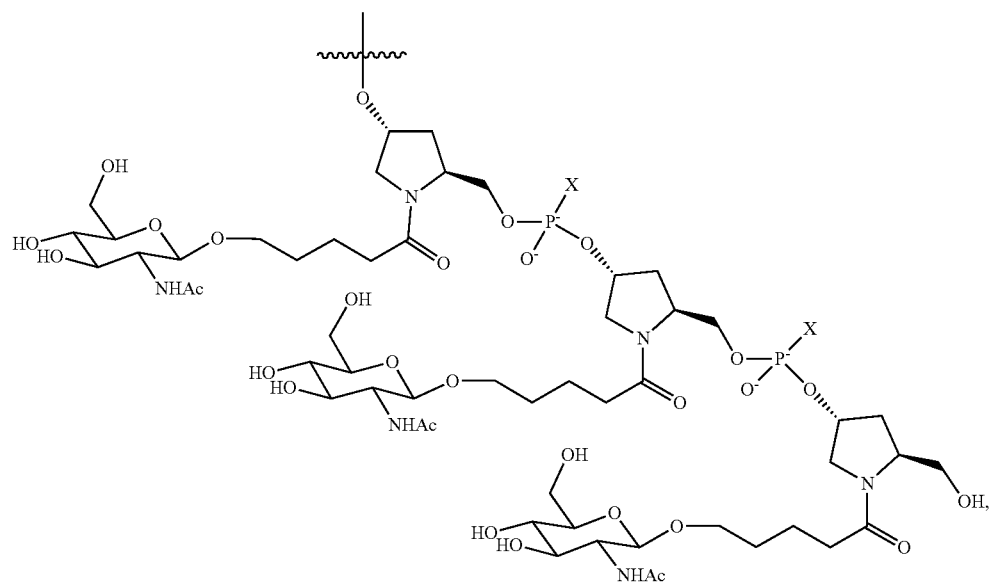
wherein X is O or S (Formula XXVII);
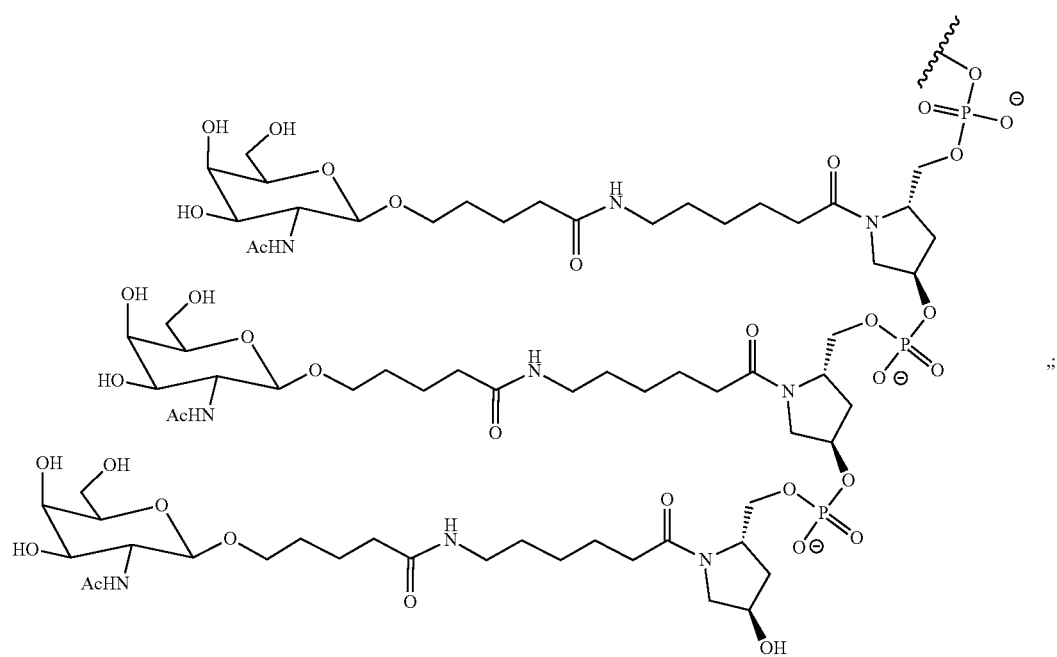

-continued
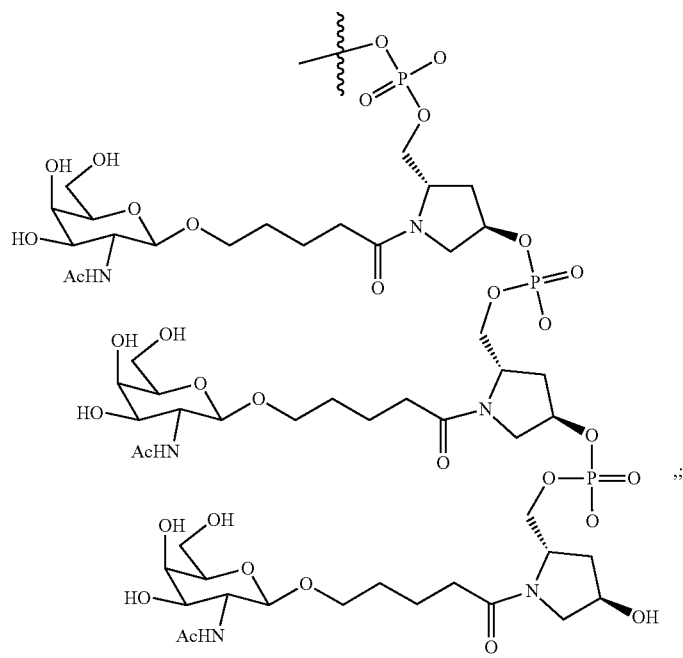
Formula XXIX
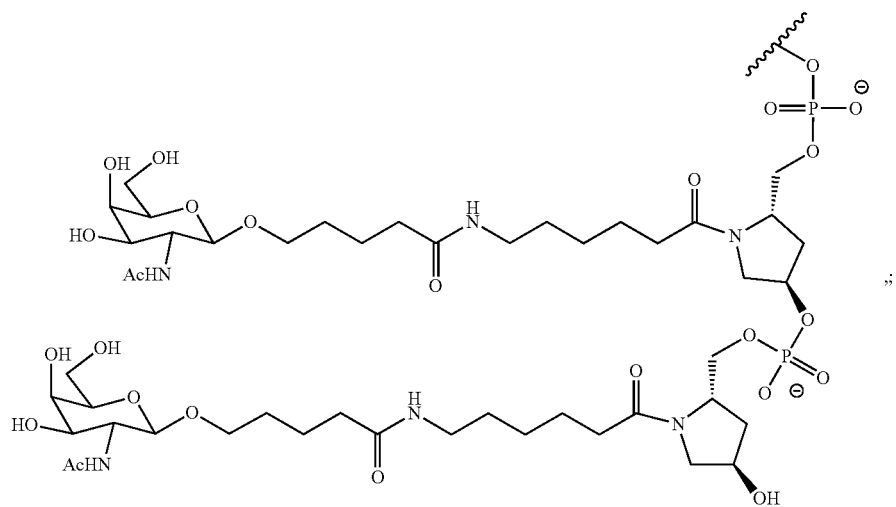
Formula XXX
Formula XXXI
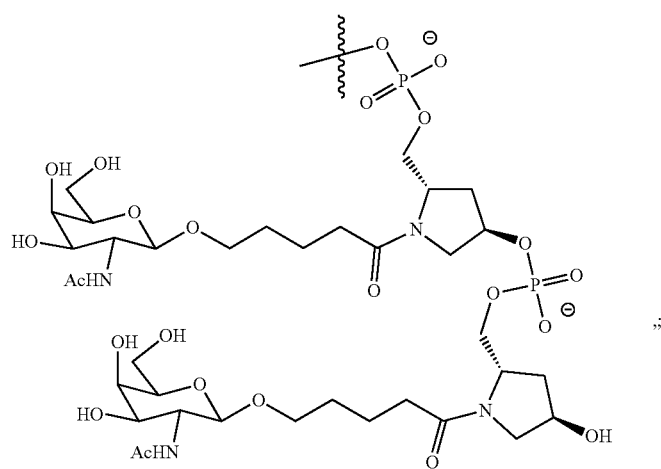

-continued
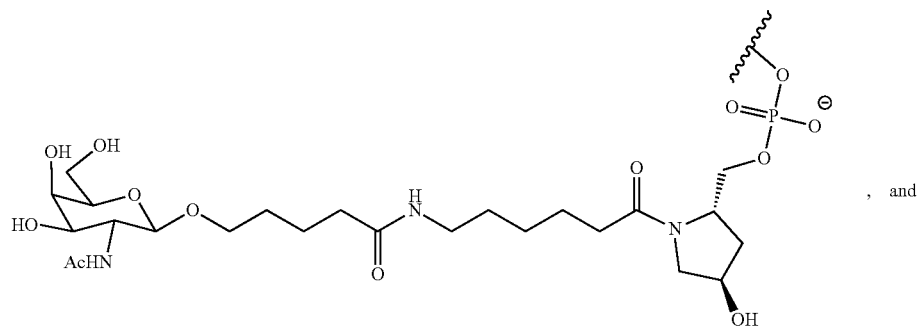
Formula XXXII
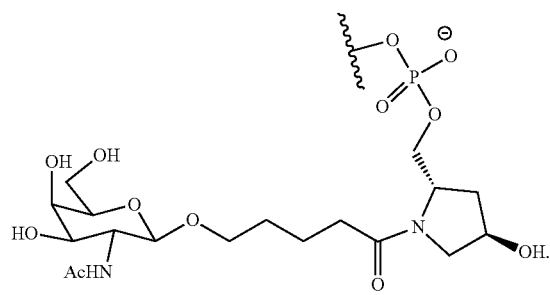
Formula XXXIII
, and
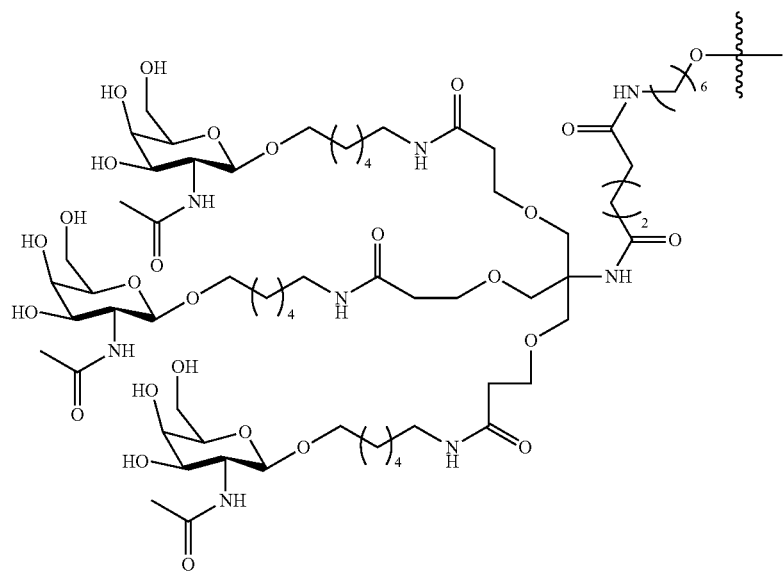
Formula XXXIV In another embodiment, a carbohydrate conjugate for use in the compositions and methods of the invention is a monosaccharide. In one embodiment, the monosaccharide is an N-acetylgalactosamine, such as
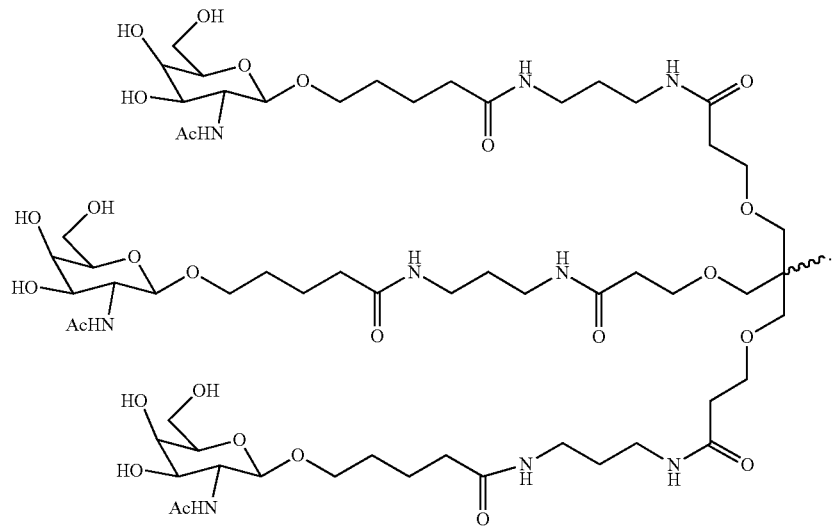
Formula II
In some embodiments, the RNAi agent is attached to the carbohydrate conjugate via a linker as shown in the following schematic, wherein X is O or S
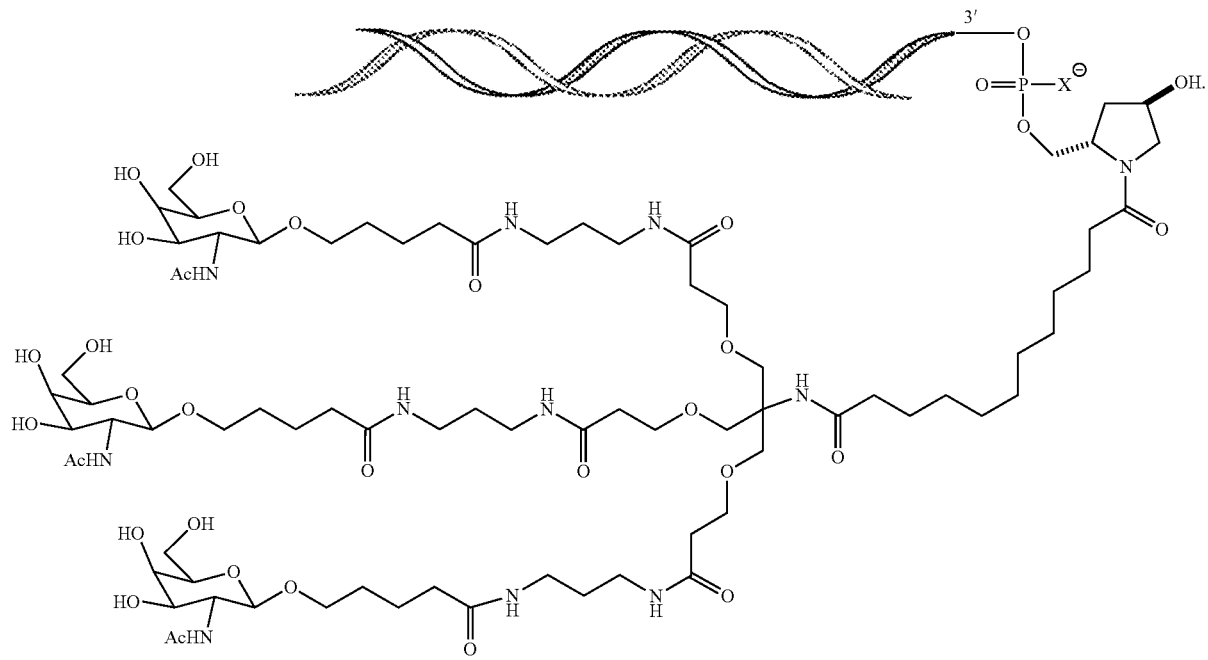

In some embodiments, the RNAi agent is conjugated to L96 as defined in Table 1 and shown below:
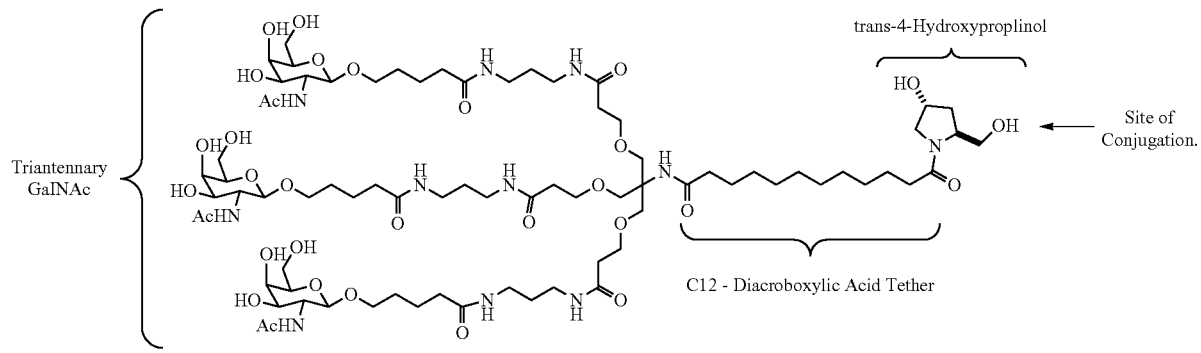
Another representative carbohydrate conjugate for use in the embodiments described herein includes, but is not limited to,
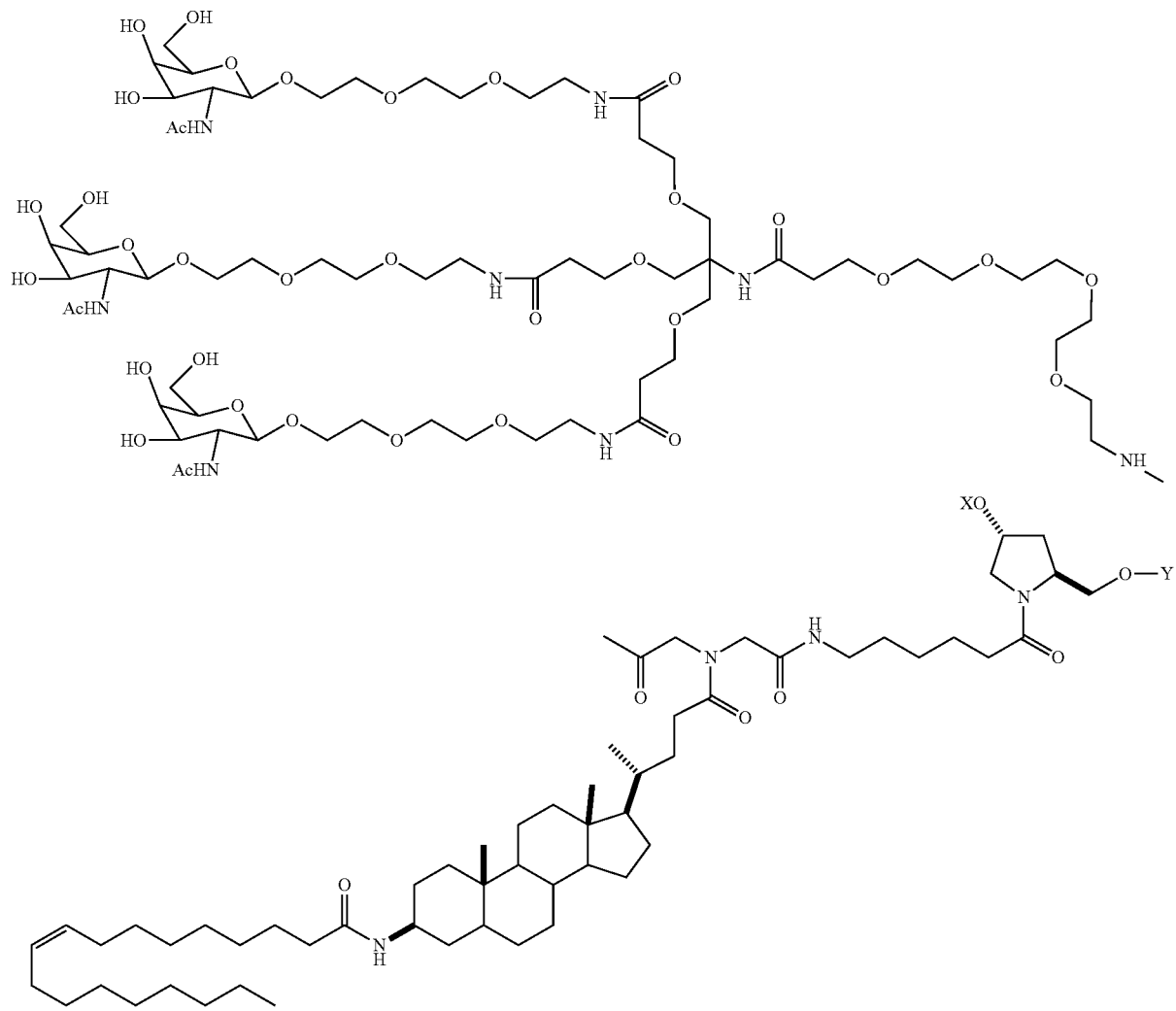

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antsisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NRB, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In one embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In some embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox cleavable linking groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-based cleavable linking groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments, a phosphate-based linking group is —O—P(O)(OH)—O—. These candidates can be evaluated using methods analogous to those described above.

iii. Acid cleavable linking groups

In other embodiments, a cleavable linker comprises an acid cleavable linking group. An acid cleavable linking group is a linking group that is cleaved under acidic conditions. In some embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-based linking groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-based cleaving groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH-). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to,

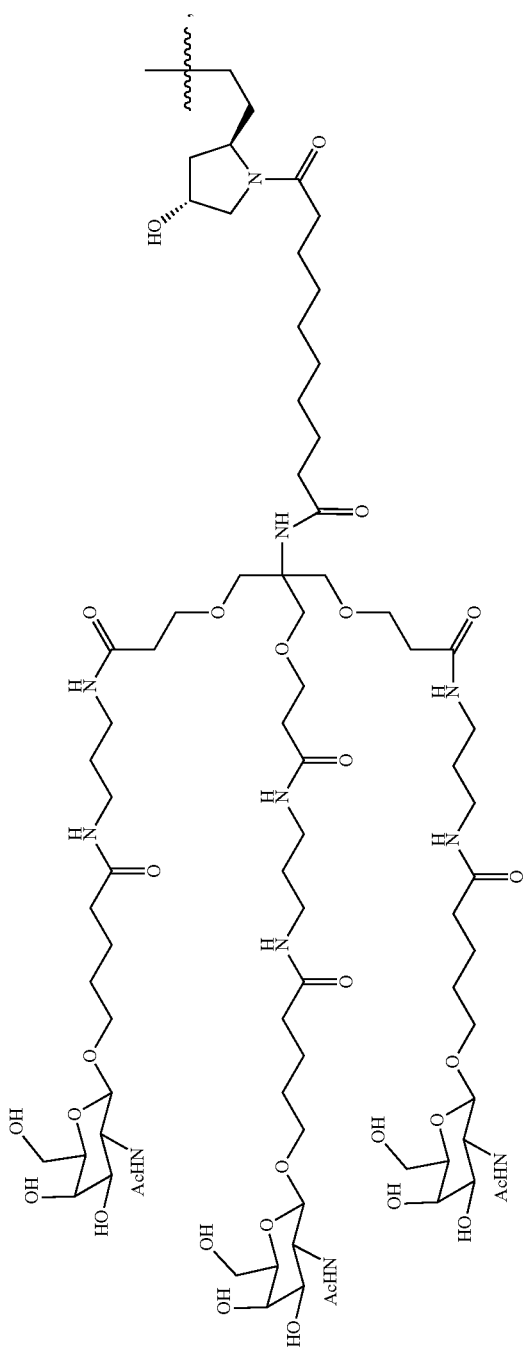
(Formula XXXVI)
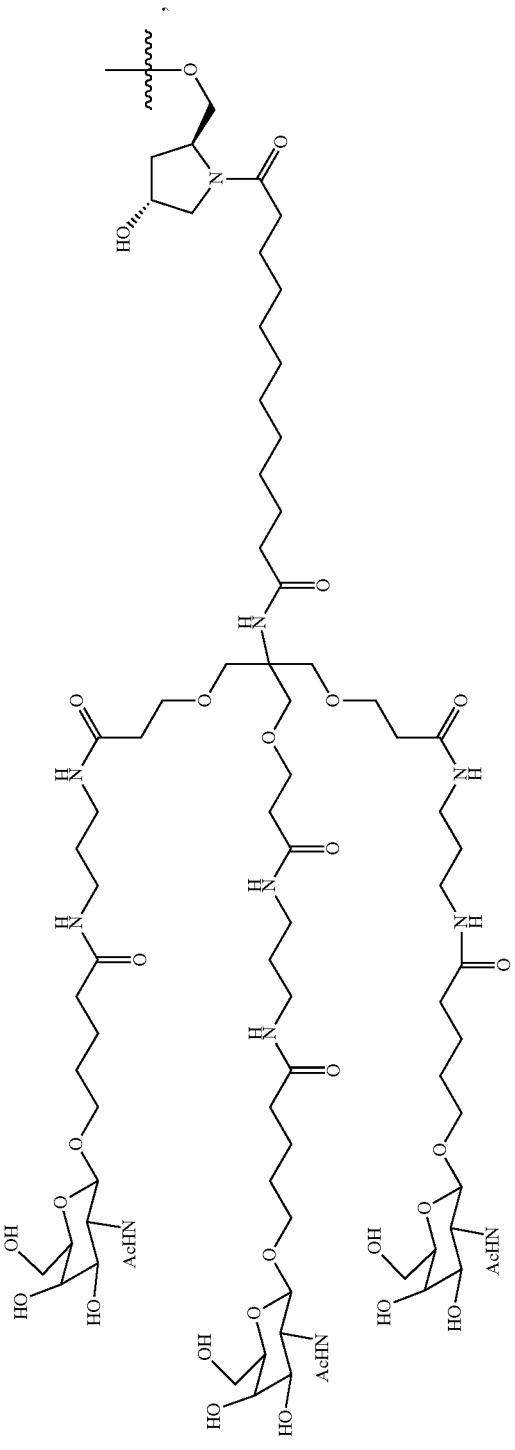
(Formula XXXVIII)

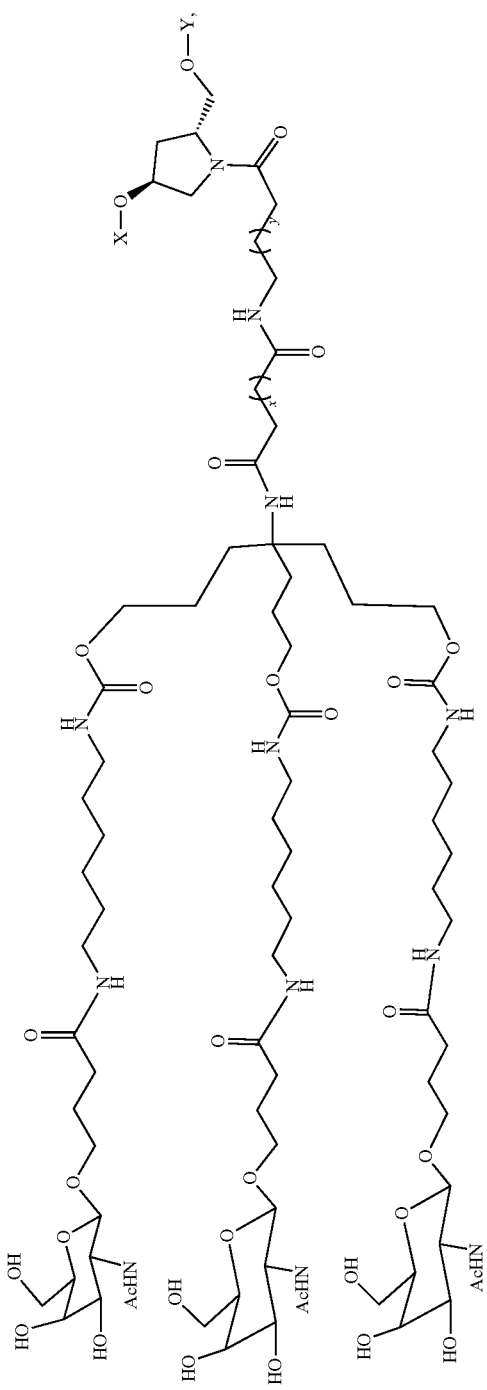
(Formula XXXIX)
x = 1-30
y = 1-15

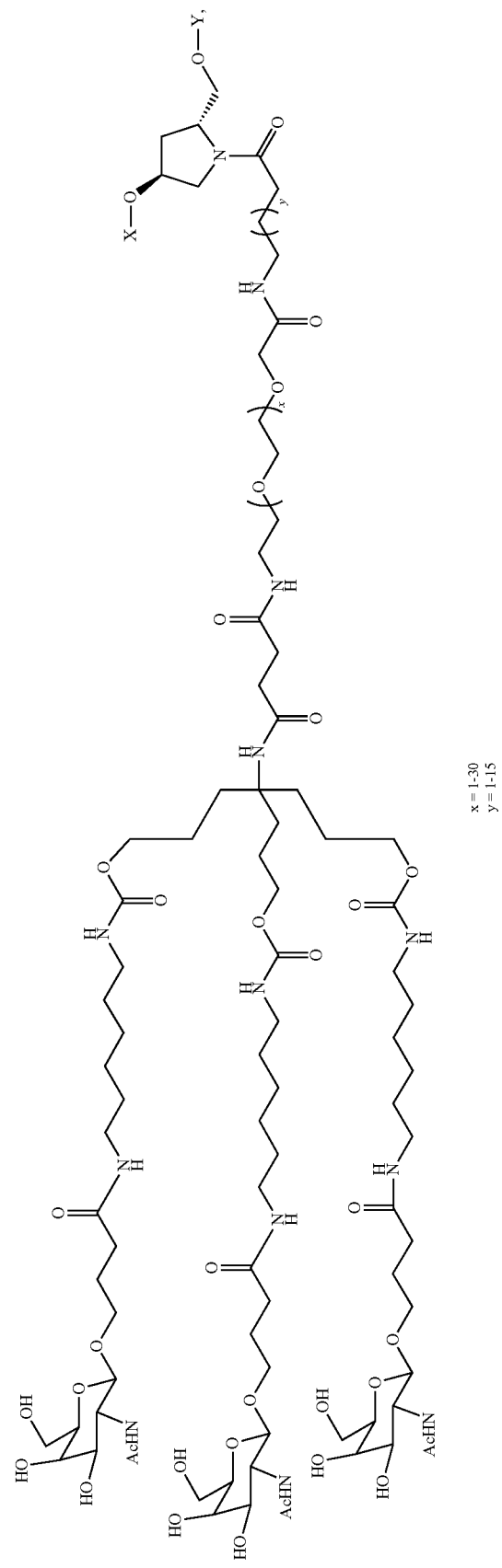
(Formula XL)
x = 1-30
y = 1-15

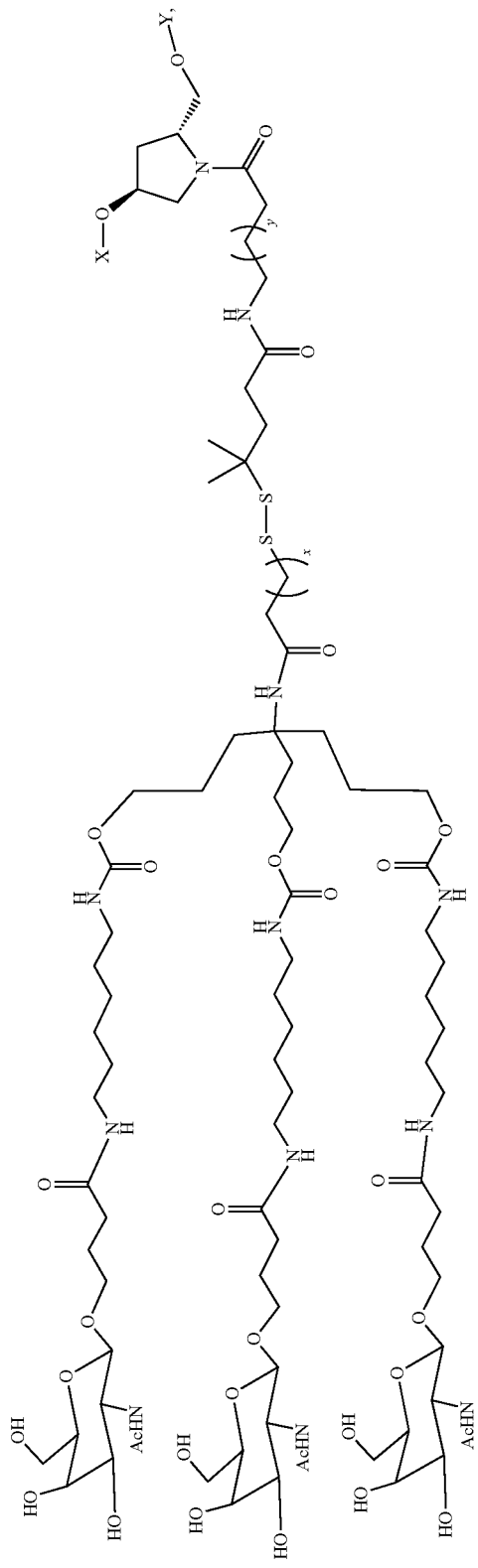
(Formula XLI)
x = 0-30
y = 1-15

-continued
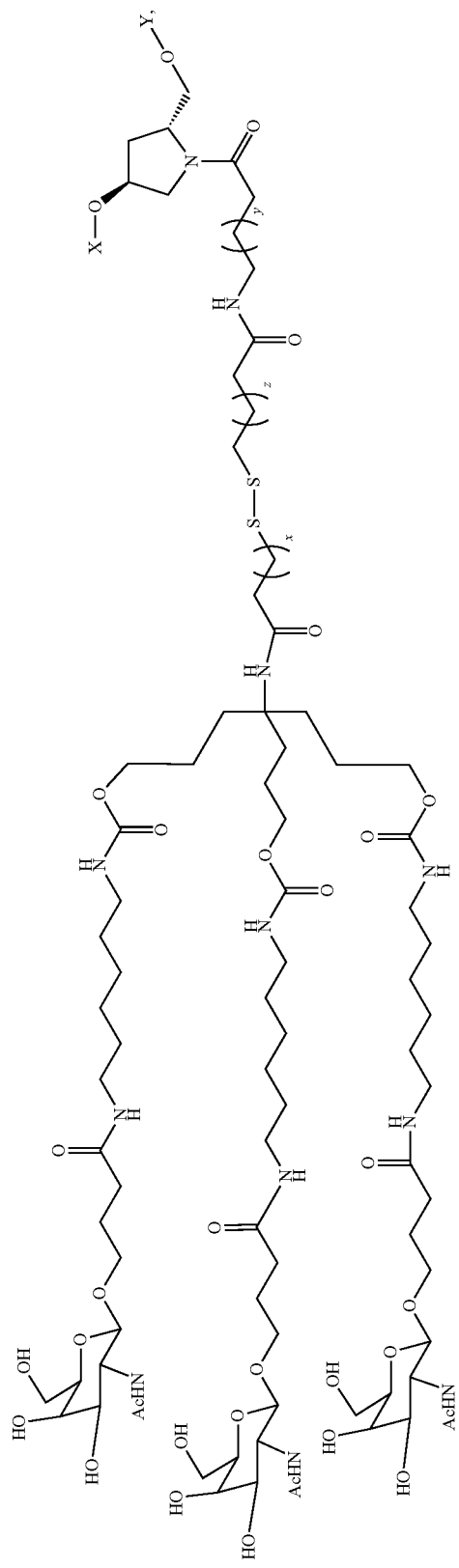
(Formula XLII)
x = 0-30
y = 1-15
z = 1-20

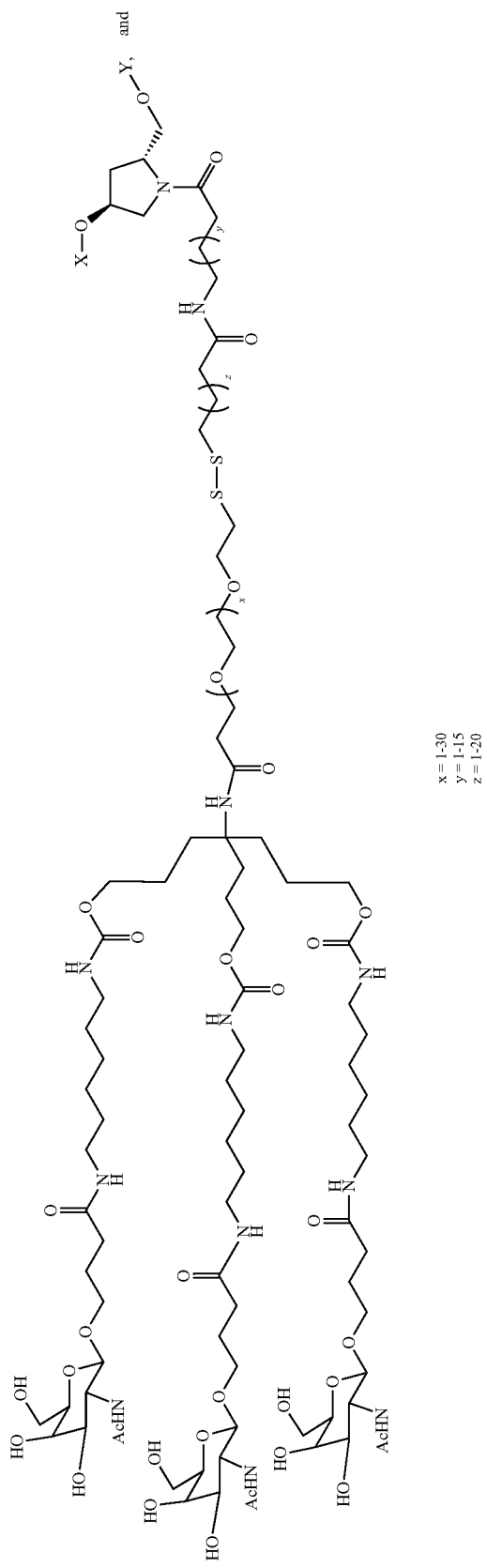
(Formula XLIII)
x = 1-30
y = 1-15
z = 1-20

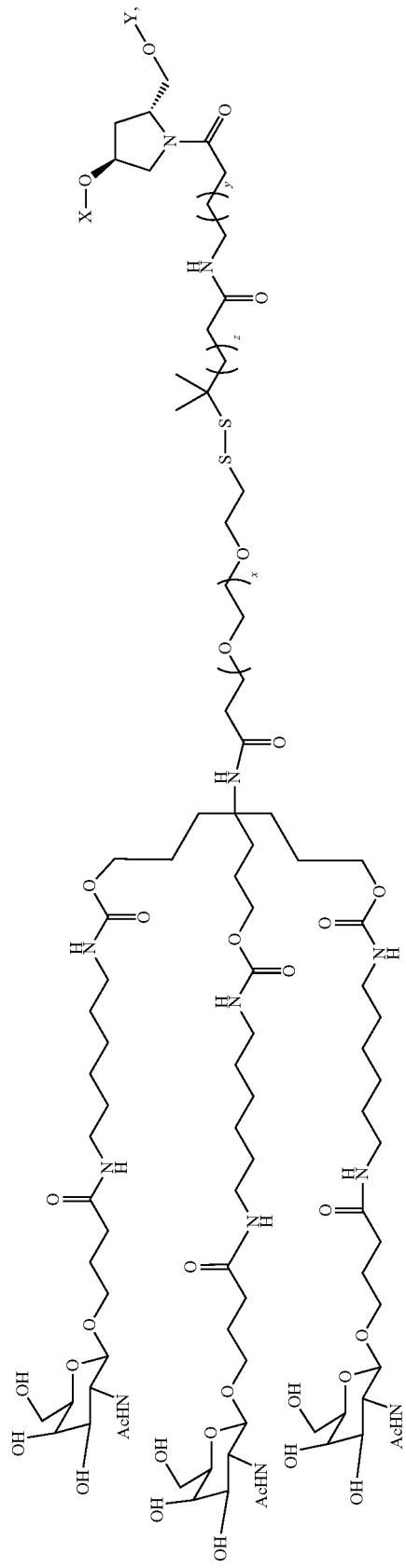
(Formula XLIV)
x = 1-30
y = 1-15
z = 1-20

(Formula XLIV), when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVIII):

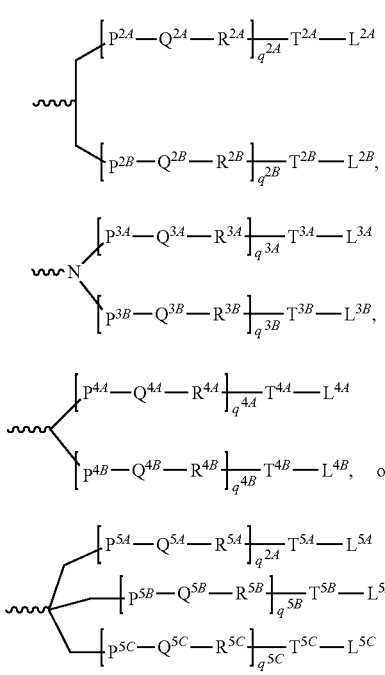

Formula XLV

Formula XLVI

Formula XLVII

Formula XVIII wherein:
q2A, q2B, q3A, q3B, q4A, q4B, q5A, q5 q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R"), CEC or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

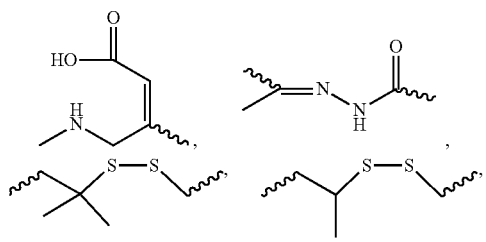

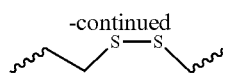

or heterocyclyl; $L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XLIX):

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241, 5,391,723; 5,416,203, 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928; 5,688,941; 6,294,664; 6,320, 017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a xanthine dehydrogenase-associated disorder) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting the xanthine dehydrogenase gene can be expressed from transcription units inserted into DNA or RNA vectors (see, e.g., Couture, A, et al., TIG. (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a xanthine dehydrogenase-associated disorder. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a xanthine dehydrogenase gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a xanthine dehydrogenase gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, or about 0.3 mg/kg to about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a xanthine dehydrogenase-associated disorder.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as, an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of a xanthine dehydrogenase-associated disorder. In any event, the administering physician can adjust the amount and timing of iRNA administration on the basis of results observed using standard measures of efficacy known in the art or described herein.

VI. Methods For Inhibiting Xanthine Dehydrogenase Expression

The present invention also provides methods of inhibiting expression of an XDH gene in a cell. The methods include contacting a cell with an RNAi agent, e.g., double stranded RNA agent, in an amount effective to inhibit expression of XDH in the cell, thereby inhibiting expression of XDH in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a xanthine dehydrogenase gene" is intended to refer to inhibition of expression of any xanthine dehydrogenase gene (such as, e.g., a mouse xanthine dehydrogenase gene, a rat xanthine dehydrogenase gene, a monkey xanthine dehydrogenase gene, or a human xanthine dehydrogenase gene) as well as variants or mutants of a xanthine dehydrogenase gene. Thus, the xanthine dehydrogenase gene may be a wild-type xanthine dehydrogenase gene, a mutant xanthine dehydrogenase gene, or a transgenic xanthine dehydrogenase gene in the context of a genetically manipulated cell, group of cells, or organism.

"Inhibiting expression of a xanthine dehydrogenase gene" includes any level of inhibition of a xanthine dehydrogenase gene, e.g., at least partial suppression of the expression of a xanthine dehydrogenase gene, such as, a clinically relevant level of supression. The expression of the xanthine dehydrogenase gene may be assessed based on the level, or the change in the level, of any variable associated with xanthine dehydrogenase gene expression, e.g., xanthine dehydrogenase mRNA level or xanthine dehydrogenase protein level, or, for example, serum uric acid levels. Inhibition may be assessed by a decrease in an absolute or relative level of one or more of these variables compared with a control level. This level may be assessed in an individual cell or in a group of cells, including, for example, a sample derived from a subject. It is understood that xanthine dehydrogenase is expressed predominantly in the liver, and is present in circulation.

Inhibition may be assessed by a decrease in an absolute or relative level of one or more variables that are associated with xanthine dehydrogenase expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a xanthine dehydrogenase gene is inhibited by at least 50%, 55%, 60%, 65%, 70%, 75%, 80%, 85%, 90%, or 95%, or to below the level of detection of the assay. In some embodiments, expression of a xanthine dehydrogenase gene is inhibited by at least 70%. It is further understood that inhibition of xanthine dehydrogenase expression in certain tissues, e.g., in gall bladder, without a significant inhibition of expression in other tissues, e.g., brain, may be desirable. In some embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., xanthine dehydrogenase), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a xanthine dehydrogenase gene may be manifested by a reduction of the amount of mRNA expressed by a first cell or group of cells (such cells may be present, for example, in a sample derived from a subject) in which a xanthine dehydrogenase gene is transcribed and which has or have been treated (e.g., by contacting the cell or cells with an iRNA of the invention, or by administering an iRNA of the invention to a subject in which the cells are or were present) such that the expression of a xanthine dehydrogenase gene is inhibited, as compared to a second cell or group of cells substantially identical to the first cell or group of cells but which has not or have not been so treated (control cell(s) not treated with an iRNA or not treated with an iRNA targeted to the gene of interest). In some embodiments, the inhibition is assessed by the method provided in Example 2 using, e.g., a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a xanthine dehydrogenase gene may be assessed in terms of a reduction of a parameter that is functionally linked to xanthine dehydrogenase gene expression, e.g., xanthine dehydrogenase protein level in blood or serum from a subject. Xanthine dehydrogenase gene silencing may be determined in any cell expressing xanthine dehydrogenase, either endogenous or heterologous from an expression construct, and by any assay known in the art.

Inhibition of the expression of a xanthine dehydrogenase protein may be manifested by a reduction in the level of the xanthine dehydrogenase protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of a xanthine dehydrogenase gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of xanthine dehydrogenase mRNA that is expressed by a cell or group of cells may be determined using any method known in the art for assessing mRNA expression. In one embodiment, the level of expression of xanthine dehydrogenase in a sample is determined by detecting a transcribed polynucleotide, or portion thereof, e.g., mRNA of the xanthine dehydrogenase gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of xanthine dehydrogenase is determined using a nucleic acid probe. The term "probe", as used herein, refers to any molecule that is capable of selectively binding to a specific xanthine dehydrogenase. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to xanthine dehydrogenase mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of xanthine dehydrogenase mRNA.

An alternative method for determining the level of expression of xanthine dehydrogenase in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of XDH is determined by quantitative fluorogenic RT-PCR (i.e., the TaqMan™ System).

In some embodiments, expression level is determined by the method provided in Example 2 using, e.g., a 10 nM siRNA concentration, in the species matched cell line.

The expression levels of xanthine dehydrogenase mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of xanthine dehydrogenase expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein. In some embodiments, expression level is determined by the method provided in Example 2 using a 10 nM siRNA concentration in the species matched cell line.

The level of XDH protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in XDH mRNA or protein level (e.g., in a liver biopsy).

In some embodiments of the methods of the invention, the iRNA is administered to a subject such that the iRNA is delivered to a specific site within the subject. The inhibition of expression of xanthine dehydrogenase may be assessed using measurements of the level or change in the level of xanthine dehydrogenase mRNA or xanthine dehydrogenase protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of xanthine dehydrogenase, thereby preventing or treating a xanthine dehydrogenase-associated disorder, e.g., hyperuricemia, gout NAFLD, NASH, metabolic disorder, insulin resistance, cardiovascular disease, hypertension, type 2 diabetes, and conditions linked to oxidative stress e.g., chronic low grade inflammation.

In one embodiment, the xanthine dehydrogenase-associate disease is hyperuricemia.

In another embodiment, the xanthine dehydrogenase-associate disease is gout.

In the methods of the invention the cell may be contacted with the siRNA in vitro or in vivo, i.e., the cell may be within a subject.

A cell suitable for treatment using the methods of the invention may be any cell that expresses a xanthine dehydrogenase gene, e.g., a liver cell, a brain cell, a gall bladder cell, a heart cell, or a kidney cell. In some embodiment, the cell is a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, xanthine dehydrogenase expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the xanthine dehydrogenase gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of XDH, or a therapeutic or prophylactic effect. A depot injection may also provide more consistent serum concentrations. Depot injections may include subcutaneous injections or intramuscular injections. In some embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In some embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a xanthine dehydrogenase gene in a mammal. The methods include administering to the mammal a composition comprising a dsRNA that targets a xanthine dehydrogenase gene in a cell of the mammal and maintaining the mammal for a time sufficient to obtain degradation of the mRNA transcript of the xanthine dehydrogenase gene, thereby inhibiting expression of the xanthine dehydrogenase gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the xanthine dehydrogenase gene or protein expression. In other embodiments, a blood sample serves as the subject sample for monitoring the reduction in the xanthine dehydrogenase protein expression.

The present invention further provides methods of treatment in a subject in need thereof, e.g., a subject diagnosed with a xanthine dehydrogenase-associated disorder, such as, hyperuricemia, gout NAFLD, NASH, metabolic disorder, insulin resistance, cardiovascular disease, hypertension, type 2 diabetes, and conditions linked to oxidative stress e.g., chronic low grade inflammation.

The present invention further provides methods of prophylaxis in a subject in need thereof. The treatment methods of the invention include administering an iRNA of the invention to a subject, e.g., a subject that would benefit from a reduction of xanthine dehydrogenase expression, in a prophylactically effective amount of an iRNA targeting a xanthine dehydrogenase gene or a pharmaceutical composition comprising an iRNA targeting a xanthine dehydrogenase gene.

In one embodiment, the xanthine dehydrogenase-associate disease is hyperuricemia.

In another embodiment, the xanthine dehydrogenase-associate disease is gout.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of xanthine dehydrogenase expression are subjects susceptible to or diagnosed with an XDH-associated disorder, e.g., hyperuricemia or gout.

In an embodiment, the method includes administering a composition featured herein such that expression of the target xanthine dehydrogenase gene is decreased, such as for about 1, 2, 3, 4, 5, 6, 1-6, 1-3, or 3-6 months per dose. In certain embodiments, the composition is administered once every 3-6 months.

In some embodiments, the iRNAs useful for the methods and compositions featured herein specifically target RNAs (primary or processed) of the target xanthine dehydrogenase gene. Compositions and methods for inhibiting the expression of these genes using iRNAs can be prepared and performed as described herein.

Administration of the iRNA according to the methods of the invention may result prevention or treatment of a xanthine dehydrogenase-associated disorder, e.g., hyperuricemia and gout.

Subjects can be administered a therapeutic amount of iRNA, such as about 0.01 mg/kg to about 200 mg/kg. Subjects can be administered a therapeutic amount of iRNA, such as about 5 mg to about 1000 mg as a fixed dose, regardless of body weight.

In some embodiments, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction or inhibition of XDH gene expression, e.g., a subject having an XDH-associated disease, in combination with other pharmaceuticals or other therapeutic methods, e.g., with known pharmaceuticals or known therapeutic methods, such as, for example, those which are currently employed for treating these disorders. Exemplary pharmaceuticals include, for example, allopurinol, oxypurinol, Probenecid, Rasburicase, febuxostat, analgesic or anti-inflammatory agents, e.g., NSAIDS.

Accordingly, in some aspects of the invention, the methods which include either a single iRNA agent of the invention, further include administering to the subject one or more additional therapeutic agents. The iRNA agent and an additional therapeutic agent or treatment may be administered at the same time or in the same combination, e.g., parenterally, or the additional therapeutic agent can be administered as part of a separate composition or at separate times or by another method known in the art or described herein.

In one embodiment, an iRNA agent is administered in combination with allopurinol. In one embodiment, the iRNA agent is administered to the patient, and then the additional therapeutic agent is administered to the patient (or vice versa). In another embodiment, the iRNA agent and the additional therapeutic agent are administered at the same time.

The iRNA agent and an additional therapeutic agent or treatment may be administered at the same time or in the same combination, e.g., parenterally, or the additional therapeutic agent can be administered as part of a separate composition or at separate times or by another method known in the art or described herein.

VIII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of XDH (e.g., means for measuring the inhibition of XDH mRNA, XDH protein, or XDH activity). Such means for measuring the inhibition of XDH may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the xanthine dehydrogenase (XDH) gene, (human: NCBI refseqID NM_000379; NCBI GeneID: 7498) were designed using custom R and Python scripts. The human NM_000379 REFSEQ mRNA, version 4, has a length of 5715 bases. Detailed lists of the unmodified XDH sense and antisense strand nucleotide sequences are shown in Table 2. Detailed lists of the modified XDH sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were synthesized and annealed using routine methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, Wis.), Hongene (China), or Chemgenes (Wilmington, Mass., USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, Mass., USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA.3HF (triethylamine trihydrofluoride). To each oligonucleotide solution in aqueous methylamine was added 200 μL of dimethyl sulfoxide (DMSO) and 300 μL TEA.3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1×PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Cell culture and Free Uptake Experiments

Primary mouse hepatocytes (PMH) or primary human hepatocytes (PHH) were freshly isolated less than 1 hour prior to transfection and grown in primary hepatocyte media.

Free uptake experiments were performed by adding 2.5 μl of siRNA duplexes in PBS per well into a 96 well plate. Complete growth media (47.5 μl) containing about $1.5 \times 10^4$ PMH or PHH was then added to the siRNA. Cells were incubated for 48 hours prior to RNA purification and RT-qPCR. Single dose experiments in PHH were performed at 500 nM, 100 nM, 10 nM and/or 0.1 nM in PHH and in PMH at 500 nM, 100 nM, nM, and 1 nM final duplex concentration.

Total RNA isolation was performed using DYNA-BEADS. Briefly, cells were lysed in 10 µl of Lysis/Binding Buffer containing 3 µL of beads per well and mixed for 10 minutes on an electrostatic shaker. The washing steps were automated on a Biotek EL406, using a magnetic plate support. Beads were washed (in 3 µL) once in Buffer A, once in Buffer B, and twice in Buffer E, with aspiration steps in between. Following a final aspiration, complete 12 µL RT mixture was added to each well, as described below.

For cDNA synthesis, a master mix of 1.5 µl 10× Buffer, 0.6 µl 10×dNTPs, 1.5 µl Random primers, 0.75 µl Reverse Transcriptase, 0.75 µl RNase inhibitor and 9.9 µl of H$_2$O per reaction were added per well. Plates were sealed, agitated for 10 minutes on an electrostatic shaker, and then incubated at 37 degrees C. for 2 hours. Following this, the plates were agitated at 80 degrees C. for 8 minutes.

For RT-qPCR, two microlitre (µl) of cDNA were added to a master mix containing 0.5 µl of human GAPDH TaqMan Probe (4326317E), 0.5 µl human APOC3, 41 nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. IC$_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 21) and antisense UCGAAGuACUcAGCGuAAGdTsdT (SEQ ID NO: 22).

The results of the free uptake experiments of the dsRNA agents listed in Tables 2 and 3 in PHH are shown in Table 4 and the results of the free uptake experiments of the dsRNA agents listed in Tables 2 and 3 in PMH are shown in Table 5.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine -3'-phosphorothioate |
| Us | uridine -3'-phosphorothioate |
| N | any nucleotide, modified or unmodified |
| a | 2'-O-methyladenosine-3'-phosphate |
| as | 2'-O-methyladenosine-3'- phosphorothioate |
| c | 2'-O-methylcytidine-3'-phosphate |
| cs | 2'-O-methylcytidine-3'- phosphorothioate |
| g | 2'-O-methylguanosine-3'-phosphate |
| gs | 2'-O-methylguanosine-3'- phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythimidine -3'-phosphate |
| dTs | 2'- deoxythimidine -3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Ahd) | 2'-O-hexadecyl-adenosine-3'-phosphate |
| (Chd) | 2'-O-hexadecyl-cytidine-3'-phosphate |
| (Ghd) | 2'-O-hexadecyl-guanosine-3'-phosphate |
| (Uhd) | 2'-O-hexadecyl-uridine-3'-phosphate |
| (Aams) | 2'-O-(N-methylacetamide)adenosine-3'-phosphorothioate |
| (Gams) | 2'-O-(N-methylacetamide)guanosine-3'-phosphorothioate |
| (Tams) | 2'-O-(N-methylacetamide)thymidine-3'-phosphorothioate |

TABLE 2

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1135979.1 | UACCUGCCAGUGUCUCUUAGU | 23 | 17-37 | ACUAAGAGACACUGGCAGGUAGU | 382 | 15-37 |
| AD-1135980.1 | ACCUGCCAGUGUCUCUUAGGU | 24 | 18-38 | ACCUAAGAGACACUGGCAGGUAG | 383 | 16-38 |
| AD-1135981.1 | CCUGCCAGUGUCUCUUAGGAU | 25 | 19-39 | AUCCUAAGAGACACUGGCAGGUA | 384 | 17-39 |
| AD-1135982.1 | UGCCAGUGUCUCUUAGGAGUU | 26 | 21-41 | AACUCCUAAGAGACACUGGCAGG | 385 | 19-41 |
| AD-1135983.1 | GCCAGUGUCUCUUAGGAGUGU | 27 | 22-42 | ACACTCCUAAGAGACACUGGCAG | 386 | 20-42 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1135984.1 | CCAGUGUCUCUUAGGAGUGAU | 28 | 23-43 | AUCACUCCUAAGAGACACUGGCA | 387 | 21-43 |
| AD-1135985.1 | CAGUGUCUCUUAGGAGUGAGU | 29 | 24-44 | ACUCACUCCUAAGAGACACUGGC | 388 | 22-44 |
| AD-1135986.1 | AGUGUCUCUUAGGAGUGAGGU | 30 | 25-45 | ACCUCACUCCUAAGAGACACUGG | 389 | 23-45 |
| AD-1135987.1 | UGGAGAAAAUGCAGAUCCAU | 31 | 123-143 | AUGGAUCUGCAUUUUUCUCCACC | 390 | 121-143 |
| AD-1135988.1 | CCAGAGACAACCCUUUUGGCU | 32 | 140-160 | AGCCAAAAGGGUUGUCUCUGGAU | 391 | 138-160 |
| AD-1135989.1 | AGAGACAACCCUUUUGGCCUU | 33 | 142-162 | AAGGCCAAAAGGGUUGUCUCUGG | 392 | 140-162 |
| AD-1135990.1 | GCACAGUGAUGCUCUCCAAGU | 34 | 228-248 | ACUUGGAGAGCAUCACUGUGCAA | 393 | 226-248 |
| AD-1135991.1 | CACAGUGAUGCUCUCCAAGUU | 35 | 229-249 | AACUGGAGAGCAUCACUGUGCA | 394 | 227-249 |
| AD-1135992.1 | GAUGCUCUCCAAGUAUGAUCU | 36 | 235-255 | AGAUCAUACUUGGAGAGCAUCAC | 395 | 233-255 |
| AD-1135993.1 | AUGCUCUCCAAGUAUGAUCGU | 37 | 236-256 | ACGAUCAUACUUGGAGAGCAUCA | 396 | 234-256 |
| AD-1135994.1 | UGCUCUCCAAGUAUGAUCGUU | 38 | 237-257 | AACGAUCAUACUUGGAGAGCAUC | 397 | 235-257 |
| AD-1135995.1 | GCUCUCCAAGUAUGAUCGUCU | 39 | 238-258 | AGACGAUCAUACUUGGAGAGCAU | 398 | 236-258 |
| AD-1135996.1 | CUCUCCAAGUAUGAUCGUCUU | 40 | 239-259 | AAGACGAUCAUACUUGGAGAGCA | 399 | 237-259 |
| AD-1135997.1 | GAUCGUCUGCAGAACAAGAUU | 41 | 251-271 | AAUCUGUUCUGCAGACGAUCAU | 400 | 249-271 |
| AD-1135998.1 | CGUCUGCAGAACAAGAUCGUU | 42 | 254-274 | AACGAUCUUGUUCUGCAGACGAU | 401 | 252-274 |
| AD-1135999.1 | GUCUGCAGAACAAGAUCGUCU | 43 | 255-275 | AGACGAUCUUGUUCUGCAGACGA | 402 | 253-275 |
| AD-1136000.1 | UCUGCAGAACAAGAUCGUCCU | 44 | 256-276 | AGGACGAUCUUGUUCUGCAGACG | 403 | 254-276 |
| AD-1136001.1 | GCAGAACAAGAUCGUCCACUU | 45 | 259-279 | AAGUGGACGAUCUUGUUCUGCAG | 404 | 257-279 |
| AD-1136002.1 | CAGAACAAGAUCGUCCACUUU | 46 | 260-280 | AAAGUGGACGAUCUUGUUCUGCA | 405 | 258-280 |
| AD-1136003.1 | GAACAAGAUCGUCCACUUUUU | 47 | 262-282 | AAAAAGUGGACGAUCUUGUUCUG | 406 | 260-282 |
| AD-1136004.1 | AACAAGAUCGUCCACUUUUCU | 48 | 263-283 | AGAAAAGUGGACGAUCUUGUUCU | 407 | 261-283 |
| AD-1136005.1 | ACAAGAUCGUCCACUUUUCUU | 49 | 264-284 | AAGAAAAGUGGACGAUCUUGUUC | 408 | 262-284 |
| AD-1136006.1 | CAAGAUCGUCCACUUUUCUGU | 50 | 265-285 | ACAGAAAAGUGGACGAUCUUGUU | 409 | 263-285 |
| AD-1136007.1 | AAGAUCGUCCACUUUUCUGCU | 51 | 266-286 | AGCAGAAAAGUGGACGAUCUUGU | 410 | 264-286 |
| AD-1136008.1 | CGUCCACUUUUCUGCCAAUGU | 52 | 271-291 | ACAUUGGCAGAAAAGUGGACGAU | 411 | 269-291 |
| AD-1136009.1 | GUCCACUUUUCUGCCAAUGCU | 53 | 272-292 | AGCAUGGCAGAAAAGUGGACGA | 412 | 270-292 |
| AD-1136010.1 | UGCUCCUUGCACCAUGUUGCU | 54 | 308-328 | AGCAACAUGGUGCAAGGAGCAGA | 413 | 306-328 |
| AD-1136011.1 | UCCUUGCACCAUGUUGCAGUU | 55 | 311-331 | AACUGCAACAUGGUGCAAGGAGC | 414 | 309-331 |
| AD-1136012.1 | UUGCACCAUGUUGCAGUGACU | 56 | 314-334 | AGUCACTGCAACAUGGUGCAAGG | 415 | 312-334 |
| AD-1136013.1 | CACCAUGUUGCAGUGACAACU | 57 | 317-337 | AGUUGUCACUGCAACAUGGUGCA | 416 | 315-337 |
| AD-1136014.1 | ACCAUGUUGCAGUGACAACUU | 58 | 318-338 | AAGUGTCACUGCAACAUGGUGC | 417 | 316-338 |
| AD-1136015.1 | AGGAGAGAAUUGCCAAAAGCU | 59 | 381-401 | AGCUUTGGCAAUUCUCUCCUGC | 418 | 379-401 |
| AD-1136016.1 | GGAGAGAAUUGCCAAAAGCCU | 60 | 382-402 | AGGCUUTGGCAAUUCUCUCCUG | 419 | 380-402 |
| AD-1136017.1 | UGGCAUCGUCAUGAGUAUGUU | 61 | 430-450 | AACAUACUCAUGACGAUGCCAGG | 420 | 428-450 |
| AD-1136018.1 | GGCAUCGUCAUGAGUAUGUAU | 62 | 431-451 | AUACAUACUCAUGACGAUGCCAG | 421 | 429-451 |
| AD-1136019.1 | GCAUCGUCAUGAGUAUGUACU | 63 | 432-452 | AGUACAUACUCAUGACGAUGCCA | 422 | 430-452 |
| AD-1136020.1 | CAUCGUCAUGAGUAUGUACAU | 64 | 433-453 | AUGUACAUACUCAUGACGAUGCC | 423 | 431-453 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136021.1 | AUCGUCAUGAGUAUGUACACU | 65 | 434-454 | AGUGUACAUACUCAUGACGAUGC | 424 | 432-454 |
| AD-1136022.1 | CGUCAUGAGUAUGUACACACU | 66 | 436-456 | AGUGUGUACAUACUCAUGACGAU | 425 | 434-456 |
| AD-1136023.1 | GUCAUGAGUAUGUACACACUU | 67 | 437-457 | AAGUGUGUACAUACUCAUGACGA | 426 | 435-457 |
| AD-1136024.1 | UCAUGAGUAUGUACACACUGU | 68 | 438-458 | ACAGUGUGUACAUACUCAUGACG | 427 | 436-458 |
| AD-1136025.1 | AAUGCCUUCCAAGGAAAUCUU | 69 | 497-517 | AAGAUUUCCUUGGAAGGCAUUCU | 428 | 495-517 |
| AD-1136026.1 | AUGCCUUCCAAGGAAAUCUGU | 70 | 498-518 | ACAGAUUUCCUUGGAAGGCAUUC | 429 | 496-518 |
| AD-1136027.1 | UGCCUUCCAAGGAAAUCUGUU | 71 | 499-519 | AACAGAUUUCCUUGGAAGGCAUU | 430 | 497-519 |
| AD-1136028.1 | GCCUUCCAAGGAAAUCUGUGU | 72 | 500-520 | ACACAGAUUUCCUUGGAAGGCAU | 431 | 498-520 |
| AD-1136029.1 | CCUUCCAAGGAAAUCUGUGCU | 73 | 501-521 | AGCACAGAUUUCCUUGGAAGGCA | 432 | 499-521 |
| AD-1136030.1 | GAGAUGAAGUUCAAGAAUAUU | 74 | 875-895 | AAUAUUCUUGAACUUCAUCUCAA | 433 | 873-895 |
| AD-1136031.1 | GAUGAAGUUCAAGAAUAUGCU | 75 | 877-897 | AGCAUAUUCUUGAACUUCAUCUC | 434 | 875-897 |
| AD-1136032.1 | AAGUUCAAGAAUAUGCUGUUU | 76 | 881-901 | AAACAGCAUAUUCUUGAACUUCA | 435 | 879-901 |
| AD-1136033.1 | AGUUCAAGAAUAUGCUGUUUU | 77 | 882-902 | AAAACAGCAUAUUCUUGAACUUC | 436 | 880-902 |
| AD-1136034.1 | GUUCAAGAAUAUGCUGUUUCU | 78 | 883-903 | AGAAACAGCAUAUUCUUGAACUU | 437 | 881-903 |
| AD-1136035.1 | UUCAAGAAUAUGCUGUUUCCU | 79 | 884-904 | AGGAAACAGCAUAUUCUUGAACU | 438 | 882-904 |
| AD-1136036.1 | AAGAAUAUGCUGUUUCCUAUU | 80 | 887-907 | AAUAGGAAACAGCAUAUUCUUGA | 439 | 885-907 |
| AD-1136037.1 | GGGAGUAUUUCUCAGCAUUCU | 81 | 1320-1340 | AGAAUGCUGAGAAAUACUCCCCC | 440 | 1318-1340 |
| AD-1136038.1 | GGAGUAUUUCUCAGCAUUCAU | 82 | 1321-1341 | AUGAAUGCUGAGAAAUACUCCCC | 441 | 1319-1341 |
| AD-1136039.1 | GAGUAUUUCUCAGCAUUCAAU | 83 | 1322-1342 | AUUGAAUGCUGAGAAAUACUCCC | 442 | 1320-1342 |
| AD-1136040.1 | AGUAUUUCUCAGCAUUCAAGU | 84 | 1323-1343 | ACUUGAAUGCUGAGAAAUACUCC | 443 | 1321-1343 |
| AD-1136041.1 | GUAUUUCUCAGCAUUCAAGCU | 85 | 1324-1344 | AGCUUGAAUGCUGAGAAAUACUC | 444 | 1322-1344 |
| AD-1136042.1 | GUGGCAUGAGAGUUUUAUUCU | 86 | 1383-1403 | AGAAUAAAACUCUCAUGCCACUG | 445 | 1381-1403 |
| AD-1136043.1 | GGCAUGAGAGUUUUAUUCAAU | 87 | 1385-1405 | AUUGAAUAAAACUCUCAUGCCAC | 446 | 1383-1405 |
| AD-1136044.1 | CAUGAGAGUUUUAUUCAAGCU | 88 | 1387-1407 | AGCUUGAAUAAAACUCUCAUGCC | 447 | 1385-1407 |
| AD-1136045.1 | CCUCACCCUCAGCUUCUUCUU | 89 | 1606-1626 | AAGAAGAAGCUGAGGGUGAGGGU | 448 | 1604-1626 |
| AD-1136046.1 | UCACCCUCAGCUUCUUCUUCU | 90 | 1608-1628 | AGAAGAAGAAGCUGAGGGUGAGG | 449 | 1606-1628 |
| AD-1136047.1 | UCUUCAAGUUCUACCUGACAU | 91 | 1623-1643 | AUGUCAGGUAGAACUUGAAGAAG | 450 | 1621-1643 |
| AD-1136048.1 | UUUCGCCAGUGCAACUUUACU | 92 | 1702-1722 | AGUAAAGUUGCACUGGCGAAAGU | 451 | 1700-1722 |
| AD-1136049.1 | UUCGCCAGUGCAACUUUACUU | 93 | 1703-1723 | AAGUAAAGUUGCACUGGCGAAAG | 452 | 1701-1723 |
| AD-1136050.1 | UUCCAGGGUUUGUUUGUUUCU | 94 | 1962-1982 | AGAAACAAACAAACCCUGGAACC | 453 | 1960-1982 |
| AD-1136051.1 | CAGGGUUUGUUUGUUUCAUUU | 95 | 1965-1985 | AAAUGAAACAAACAAACCCUGGA | 454 | 1963-1985 |
| AD-1136052.1 | GGGUUUGUUUGUUUCAUUUCU | 96 | 1967-1987 | AGAAAUGAAACAAACAAACCCUG | 455 | 1965-1987 |
| AD-1136053.1 | GGUUUGUUUGUUUCAUUUCCU | 97 | 1968-1988 | AGGAAAUGAAACAAACAAACCCU | 456 | 1966-1988 |
| AD-1136054.1 | UUGUUUGUUUCAUUUCCGCUU | 98 | 1971-1991 | AAGCGGAAAUGAAACAAACAAAC | 457 | 1969-1991 |
| AD-1136055.1 | UUCCUGGGAGUAACAUAACUU | 99 | 1998-2018 | AAGUUAUGUUACUCCCAGGAACA | 458 | 1996-2018 |
| AD-1136056.1 | GGGAGUAACAUAACUGGAAUU | 100 | 2003-2023 | AAUUCCAGUUAUGUUACUCCCAG | 459 | 2001-2023 |
| AD-1136057.1 | UAACAUAACUGGAAUUUGUAU | 101 | 2008-2028 | AUACAAAUUCCAGUUAUGUUACU | 460 | 2006-2028 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136058.1 | AACAUAACUGGAAUUUGUAAU | 102 | 2009-2029 | AUUACAAAUUCCAGUUAUGUUAC | 461 | 2007-2029 |
| AD-1136059.1 | CGAAGGAUAAGGUUACUUGUU | 103 | 2046-2066 | AACAAGUAACCUUAUCCUUCGCA | 462 | 2044-2066 |
| AD-1136060.1 | GAAGGAUAAGGUUACUUGUGU | 104 | 2047-2067 | ACACAAGUAACCUUAUCCUUCGC | 463 | 2045-2067 |
| AD-1136061.1 | GGGUGAAAAUCACCUAUGAAU | 105 | 2130-2150 | AUUCAUAGGUGAUUUUCACCCCU | 464 | 2128-2150 |
| AD-1136062.1 | AAUCACCUAUGAAGAACUACU | 106 | 2137-2157 | AGUAGUCUUCAUAGGUGAUUUU | 465 | 2135-2157 |
| AD-1136063.1 | AUCACCUAUGAAGAACUACCU | 107 | 2138-2158 | AGGUAGUCUUCAUAGGUGAUUU | 466 | 2136-2158 |
| AD-1136064.1 | UACCAGCCAUUAUCACAAUUU | 108 | 2154-2174 | AAAUGUGAUAAUGGCUGGUAGU | 467 | 2152-2174 |
| AD-1136065.1 | GAACAACUCCUUUUAUGGACU | 109 | 2188-2208 | AGUCCAUAAAAGGAGUUGUUCUU | 468 | 2186-2208 |
| AD-1136066.1 | GGCCAAGAGCACUUCUACCUU | 110 | 2291-2311 | AAGGUAGAAGUGCUCUUGGCCAC | 469 | 2289-2311 |
| AD-1136067.1 | GAGCACUUCUACCUGGAGACU | 111 | 2297-2317 | AGUCUCCAGGUAGAAGUGCUCUU | 470 | 2295-2317 |
| AD-1136068.1 | GCACUUCUACCUGGAGACUCU | 112 | 2299-2319 | AGAGUCUCCAGGUAGAAGUGCUC | 471 | 2297-2319 |
| AD-1136069.1 | CACUUCUACCUGGAGACUCAU | 113 | 2300-2320 | AUGAGUCUCCAGGUAGAAGUGCU | 472 | 2298-2320 |
| AD-1136070.1 | UCACUGCACCAUUGCUGUUCU | 114 | 2317-2337 | AGAACAGCAAUGGUGCAGUGAGU | 473 | 2315-2337 |
| AD-1136071.1 | CACUGCACCAUUGCUGUUCCU | 115 | 2318-2338 | AGGAACAGCAAUGGUGCAGUGAG | 474 | 2316-2338 |
| AD-1136072.1 | CCAUUGCUGUUCCAAAAGGCU | 116 | 2325-2345 | AGCCUUUUGGAACAGCAAUGGUG | 475 | 2323-2345 |
| AD-1136073.1 | AGCUCUUUGUGUCUACACAGU | 117 | 2361-2381 | ACUGUGUAGACACAAAGAGCUCC | 476 | 2359-2381 |
| AD-1136074.1 | GCUCUUUGUGUCUACACAGAU | 118 | 2362-2382 | AUCUGUGUAGACACAAAGAGCUC | 477 | 2360-2382 |
| AD-1136075.1 | CUCUUUGUGUCUACACAGAAU | 119 | 2363-2383 | AUUCUGUGUAGACACAAAGAGCU | 478 | 2361-2383 |
| AD-1136076.1 | UCUUUGUGUCUACACAGAACU | 120 | 2364-2384 | AGUUCUGUGUAGACACAAAGAGC | 479 | 2362-2384 |
| AD-1136077.1 | CUUUGUGUCUACACAGAACAU | 121 | 2365-2385 | AUGUUCUGUGUAGACACAAAGAG | 480 | 2363-2385 |
| AD-1136078.1 | UUUGUGUCUACACAGAACACU | 122 | 2366-2386 | AGUGUUCUGUGUAGACACAAAGA | 481 | 2364-2386 |
| AD-1136079.1 | ACACAGAACACCAUGAAGACU | 123 | 2375-2395 | AGUCUUCAUGGUGUUCUGUGUAG | 482 | 2373-2395 |
| AD-1136080.1 | GAGCUUUGUUGCAAAAAUGUU | 124 | 2398-2418 | AACAUUUUUGCAACAAAGCUCUG | 483 | 2396-2418 |
| AD-1136081.1 | AGCUUUGUUGCAAAAAUGUUU | 125 | 2399-2419 | AAACAUUUUUGCAACAAAGCUCU | 484 | 2397-2419 |
| AD-1136082.1 | AGGAUCUCUCUCAGAGUAUUU | 126 | 2691-2711 | AAAUACUCUGAGAGAGAUCCUGG | 485 | 2689-2711 |
| AD-1136083.1 | GGAUCUCUCUCAGAGUAUUAU | 127 | 2692-2712 | AUAAUACUCUGAGAGAGAUCCUG | 486 | 2690-2712 |
| AD-1136084.1 | GAUCUCUCUCAGAGUAUUAUU | 128 | 2693-2713 | AAUAAUACUCUGAGAGAGAUCCU | 487 | 2691-2713 |
| AD-1136085.1 | AUCUCUCUCAGAGUAUUAUGU | 129 | 2694-2714 | ACAUAAUACUCUGAGAGAGAUCC | 488 | 2692-2714 |
| AD-1136086.1 | UCUCUCUCAGAGUAUUAUGGU | 130 | 2695-2715 | ACCAUAAUACUCUGAGAGAGAUC | 489 | 2693-2715 |
| AD-1136087.1 | CUCUCUCAGAGUAUUAUGGAU | 131 | 2696-2716 | AUCCAUAAUACUCUGAGAGAGAU | 490 | 2694-2716 |
| AD-1136088.1 | UCUCUCAGAGUAUUAUGGAAU | 132 | 2697-2717 | AUUCCAUAAUACUCUGAGAGAGA | 491 | 2695-2717 |
| AD-1136089.1 | CUCUCAGAGUAUUAUGGAACU | 133 | 2698-2718 | AGUUCCAUAAUACUCUGAGAGAG | 492 | 2696-2718 |
| AD-1136090.1 | UCUCAGAGUAUUAUGGAACGU | 134 | 2699-2719 | ACGUUCCAUAAUACUCUGAGAGA | 493 | 2697-2719 |
| AD-1136091.1 | UCAGAGUAUUAUGGAACGAGU | 135 | 2701-2721 | ACUCGUUCCAUAAUACUCUGAGA | 494 | 2699-2721 |
| AD-1136092.1 | CAGAGUAUUAUGGAACGAGCU | 136 | 2702-2722 | AGCUCGUUCCAUAAUACUCUGAG | 495 | 2700-2722 |
| AD-1136093.1 | GCUGUGCAAAACCAACCUUCU | 137 | 2776-2796 | AGAAGGUGGUUUUGCACAGCCG | 496 | 2774-2796 |
| AD-1136094.1 | CUGUGCAAAACCAACCUUCCU | 138 | 2777-2797 | AGGAAGGUUGGUUUUGCACAGCC | 497 | 2775-2797 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136095.1 | CCUGACACACUUCAACCAGAU | 139 | 2932-2952 | AUCUGGUUGAAGUGUGUCAGGUC | 498 | 2930-2952 |
| AD-1136096.1 | UGACACACUUCAACCAGAAGU | 140 | 2934-2954 | ACUUCUGGUUGAAGUGUGUCAGG | 499 | 2932-2954 |
| AD-1136097.1 | GACACACUUCAACCAGAAGCU | 141 | 2935-2955 | AGCUUCUGGUUGAAGUGUGUCAG | 500 | 2933-2955 |
| AD-1136098.1 | ACACUUCAACCAGAAGCUUGU | 142 | 2938-2958 | ACAAGCUUCUGGUUGAAGUGUGU | 501 | 2936-2958 |
| AD-1136099.1 | AUGCCUAGCAAGCUCUCAGUU | 143 | 2989-3009 | AACUGAGAGCUUGCUAGGCAUUC | 502 | 2987-3009 |
| AD-1136100.1 | CCUAGCAAGCUCUCAGUAUCU | 144 | 2992-3012 | AGAUACUGAGAGCUUGCUAGGCA | 503 | 2990-3012 |
| AD-1136101.1 | CUAGCAAGCUCUCAGUAUCAU | 145 | 2993-3013 | AUGAUACUGAGAGCUUGCUAGGC | 504 | 2991-3013 |
| AD-1136102.1 | UAGCAAGCUCUCAGUAUCAUU | 146 | 2994-3014 | AAUGAUACUGAGAGCUUGCUAGG | 505 | 2992-3014 |
| AD-1136103.1 | AGCAAGCUCUCAGUAUCAUGU | 147 | 2995-3015 | ACAUGAUACUGAGAGCUUGCUAG | 506 | 2993-3015 |
| AD-1136104.1 | CAAGCUCUCAGUAUCAUGCUU | 148 | 2997-3017 | AAGCAUGAUACUGAGAGCUUGCU | 507 | 2995-3017 |
| AD-1136105.1 | CUCGGAAGAGUGAGGUUGACU | 149 | 3015-3035 | AGUCAACCUCACUCUUCCGAGCA | 508 | 3013-3035 |
| AD-1136106.1 | AAGGAGAAUUGUUGGAAAAAU | 150 | 3044-3064 | AUUUUCCAACAAUUCUCCUUGU | 509 | 3042-3064 |
| AD-1136107.1 | CACCAAGUUUGGAAUAAGCUU | 151 | 3085-3105 | AAGCUUAUUCCAAACUUGGUGGG | 510 | 3083-3105 |
| AD-1136108.1 | ACCAAGUUUGGAAUAAGCUUU | 152 | 3089-3109 | AAAGCUUAUUCCAAACUUGGUGG | 511 | 3087-3109 |
| AD-1136109.1 | AGUUCCUUUUCUGAAUCAGGU | 153 | 3109-3129 | ACCUGAUUCAGAAAAGGAACUGU | 512 | 3107-3129 |
| AD-1136110.1 | GUUCCUUUUCUGAAUCAGGCU | 154 | 3110-3130 | AGCCUGAUUCAGAAAAGGAACUG | 513 | 3108-3130 |
| AD-1136111.1 | UUCCUUUUCUGAAUCAGGCAU | 155 | 3111-3131 | AUGCCUGAUUCAGAAAAGGAACU | 514 | 3109-3131 |
| AD-1136112.1 | UACUUCAUGUGUACACAGAUU | 156 | 3138-3158 | AAUCUGUGUACACAUGAAGUAGG | 515 | 3136-3158 |
| AD-1136114.1 | CAAGGCCUUCAUACCAAAAUU | 157 | 3197-3217 | AAUUUGGUAUGAAGGCCUUGGC | 516 | 3195-3217 |
| AD-1136115.1 | AAGGCCUUCAUACCAAAAUGU | 158 | 3198-3218 | ACAUUUUGGUAUGAAGGCCUUGG | 517 | 3196-3218 |
| AD-1136116.1 | GCCUUCAUACCAAAAUGGUCU | 159 | 3201-3221 | AGACCAUUUUGGUAUGAAGGCCU | 518 | 3199-3221 |
| AD-1136117.1 | CACCUCUAAGAUUUAUAUCAU | 160 | 3250-3270 | AUGAUAUAAAUCUUAGAGGUGGG | 519 | 3248-3270 |
| AD-1136118.1 | ACCUCUAAGAUUUAUAUCAGU | 161 | 3251-3271 | ACUGAUAUAAAUCUUAGAGGUGG | 520 | 3249-3271 |
| AD-1136119.1 | GCGAGACAAGCACUAACACUU | 162 | 3270-3290 | AAGUGUUAGUGCUUGUCUCGCUG | 521 | 3268-3290 |
| AD-1136120.1 | CGAGACAAGCACUAACACUGU | 163 | 3271-3291 | ACAGTGTUAGUGCUUGUCUCGCU | 522 | 3269-3291 |
| AD-1136121.1 | GAGACAAGCACUAACACUGUU | 164 | 3272-3292 | AACAGUGUUAGUGCUUGUCUCGC | 523 | 3270-3292 |
| AD-1136122.1 | AGACAAGCACUAACACUGUGU | 165 | 3273-3293 | ACACAGTGUUAGUGCUUGUCUCG | 524 | 3271-3293 |
| AD-1136123.1 | CGGCUUGUCAGACCAUCUUGU | 166 | 3354-3374 | ACAAGAUGGUCUGACAAGCCGCA | 525 | 3352-3374 |
| AD-1136124.1 | GGCUUGUCAGACCAUCUUGAU | 167 | 3355-3375 | AUCAAGAUGGUCUGACAAGCCGC | 526 | 3353-3375 |
| AD-1136125.1 | GCUUGUCAGACCAUCUUGAAU | 168 | 3356-3376 | AUUCAAGAUGGUCUGACAAGCCG | 527 | 3354-3376 |
| AD-1136126.1 | CUUGUCAGACCAUCUUGAAAU | 169 | 3357-3377 | AUUUCAAGAUGGUCUGACAAGCC | 528 | 3355-3377 |
| AD-1136127.1 | UUGUCAGACCAUCUUGAAAAU | 170 | 3358-3378 | AUUUUCAAGAUGGUCUGACAAGC | 529 | 3356-3378 |
| AD-1136128.1 | UGUCAGACCAUCUUGAAAAGU | 171 | 3359-3379 | ACUUUUCAAGAUGGUCUGACAAG | 530 | 3357-3379 |
| AD-1136129.1 | GUCAGACCAUCUUGAAAAGGU | 172 | 3360-3380 | ACCUUUUCAAGAUGGUCUGACAA | 531 | 3358-3380 |
| AD-1136130.1 | UCAGACCAUCUUGAAAAGGCU | 173 | 3361-3381 | AGCCUUUUCAAGAUGGUCUGACA | 532 | 3359-3381 |
| AD-1136131.1 | ACCCUACAAGAAGAAGAAUCU | 174 | 3385-3405 | AGAUUCUUCUUCUUGUAGGGUUC | 533 | 3383-3405 |
| AD-1136132.1 | CUGCCACUGGGUUUUAUAGAU | 175 | 3462-3482 | AUCUAUAAAACCCAGUGGCAGAC | 534 | 3460-3482 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136133.1 | UGCCACUGGGUUUUAUAGAAU | 176 | 3463-3483 | AUUCUAUAAAACCCAGUGGCAGA | 535 | 3461-3483 |
| AD-1136134.1 | CACUGGGUUUUAUAGAACACU | 177 | 3466-3486 | AGUGUUCUAUAAAACCCAGUGGC | 536 | 3464-3486 |
| AD-1136135.1 | ACUGGGUUUUAUAGAACACCU | 178 | 3467-3487 | AGGUGUUCUAUAAAACCCAGUGG | 537 | 3465-3487 |
| AD-1136136.1 | GGGUUUUAUAGAACACCCAU | 179 | 3470-3490 | AUUGGGUGUUCUAUAAAACCCAG | 538 | 3468-3490 |
| AD-1136137.1 | GGUUUUAUAGAACACCCAAUU | 180 | 3471-3491 | AAUUGGGUGUUCUAUAAAACCCA | 539 | 3469-3491 |
| AD-1136138.1 | UGGGCUACAGCUUUGAGACUU | 181 | 3492-3512 | AAGUCUCAAAGCUGUAGCCCAGA | 540 | 3490-3512 |
| AD-1136139.1 | GGGCUACAGCUUUGAGACUAU | 182 | 3493-3513 | AUAGUCUCAAAGCUGUAGCCCAG | 541 | 3491-3513 |
| AD-1136140.1 | GCUACAGCUUUGAGACUAACU | 183 | 3495-3515 | AGUUAGUCUCAAAGCUGUAGCCC | 542 | 3493-3515 |
| AD-1136141.1 | CUACAGCUUUGAGACUAACUU | 184 | 3496-3516 | AAGUUAGUCUCAAAGCUGUAGCC | 543 | 3494-3516 |
| AD-1136142.1 | UACAGCUUUGAGACUAACUCU | 185 | 3497-3517 | AGAGUUAGUCUCAAAGCUGUAGC | 544 | 3495-3517 |
| AD-1136143.1 | ACAGCUUUGAGACUAACUCAU | 186 | 3498-3518 | AUGAGUUAGUCUCAAAGCUGUAG | 545 | 3496-3518 |
| AD-1136144.1 | CAGCUUUGAGACUAACUCAGU | 187 | 3499-3519 | ACUGAGUUAGUCUCAAAGCUGUA | 546 | 3497-3519 |
| AD-1136145.1 | AGCUUUGAGACUAACUCAGGU | 188 | 3500-3520 | ACCUGAGUUAGUCUCAAAGCUGU | 547 | 3498-3520 |
| AD-1136146.1 | CUUCCACUACUUCAGCUAUGU | 189 | 3526-3546 | ACAUAGCUGAAGUAGUGGAAGGG | 548 | 3524-3546 |
| AD-1136147.1 | UUCCACUACUUCAGCUAUGGU | 190 | 3527-3547 | ACCAUAGCUGAAGUAGUGGAAGG | 549 | 3525-3547 |
| AD-1136148.1 | GUGGCUUGCUCUGAAGUAGAU | 191 | 3548-3568 | AUCUACUUCAGAGCAAGCCACCC | 550 | 3546-3568 |
| AD-1136149.1 | UGGCUUGCUCUGAAGUAGAAU | 192 | 3549-3569 | AUUCUACUUCAGAGCAAGCCACC | 551 | 3547-3569 |
| AD-1136150.1 | GGCUUGCUCUGAAGUAGAAAU | 193 | 3550-3570 | AUUUCUACUUCAGAGCAAGCCAC | 552 | 3548-3570 |
| AD-1136151.1 | GCUUGCUCUGAAGUAGAAAUU | 194 | 3551-3571 | AAUUCUACUUCAGAGCAAGCCA | 553 | 3549-3571 |
| AD-1136152.1 | CCUAACAGGAGAUCAUAAGAU | 195 | 3577-3597 | AUCUUAUGAUCUCCUGUUAGGCA | 554 | 3575-3597 |
| AD-1136153.1 | CUAACAGGAGAUCAUAAGAAU | 196 | 3578-3598 | AUUCUAUGAUCUCCUGUUAGGC | 555 | 3576-3598 |
| AD-1136154.1 | UAACAGGAGAUCAUAAGAACU | 197 | 3579-3599 | AGUUCUUAUGAUCUCCUGUUAGG | 556 | 3577-3599 |
| AD-1136155.1 | AACAGGAGAUCAUAAGAACCU | 198 | 3580-3600 | AGGUUCUUAUGAUCUCCUGUUAG | 557 | 3578-3600 |
| AD-1136156.1 | CCUCCGCACAGAUAUUGUCAU | 199 | 3598-3618 | AUGACAAUAUCUGUGCGGAGGUU | 558 | 3596-3618 |
| AD-1136157.1 | CUCCGCACAGAUAUUGUCAUU | 200 | 3599-3619 | AAUGACAAUAUCUGUGCGGAGGU | 559 | 3597-3619 |
| AD-1136158.1 | UUGGCUCCAGUCUAAACCCUU | 201 | 3624-3644 | AAGGGUUUAGACUGGAGCCAACA | 560 | 3622-3644 |
| AD-1136159.1 | UUCCUGGCUGCUUCUAUCUUU | 202 | 3872-3892 | AAAGAUAGAAGCAGCCAGGAAGA | 561 | 3870-3892 |
| AD-1136160.1 | UCCUGGCUGCUUCUAUCUUCU | 203 | 3873-3893 | AGAAGAUAGAAGCAGCCAGGAAG | 562 | 3871-3893 |
| AD-1136161.1 | CCUGGCUGCUUCUAUCUUCUU | 204 | 3874-3894 | AAGAAGAUAGAAGCAGCCAGGAA | 563 | 3872-3894 |
| AD-1136162.1 | CUGGCUGCUUCUAUCUUCUUU | 205 | 3875-3895 | AAAGAAGAUAGAAGCAGCCAGGA | 564 | 3873-3895 |
| AD-1136163.1 | UGGCUGCUUCUAUCUUCUUUU | 206 | 3876-3896 | AAAAGAAGAUAGAAGCAGCCAGG | 565 | 3874-3896 |
| AD-1136164.1 | GCUGCUUCUAUCUUCUUUGCU | 207 | 3878-3898 | AGCAAAGAAGAUAGAAGCAGCCA | 566 | 3876-3898 |
| AD-1136165.1 | CUGCUUCUAUCUUCUUUGCCU | 208 | 3879-3899 | AGGCAAAGAAGAUAGAAGCAGCC | 567 | 3877-3899 |
| AD-1136166.1 | UGCUUCUAUCUUCUUUGCCAU | 209 | 3880-3900 | AUGGCAAAGAAGAUAGAAGCAGC | 568 | 3878-3900 |
| AD-1136167.1 | GCUUCUAUCUUCUUUGCCAUU | 210 | 3881-3901 | AAUGGCAAAGAAGAUAGAAGCAG | 569 | 3879-3901 |
| AD-1136168.1 | CUUCUAUCUUCUUUGCCAUCU | 211 | 3882-3902 | AGAUGGCAAAGAAGAUAGAAGCA | 570 | 3880-3902 |
| AD-1136169.1 | UUCUAUCUUCUUUGCCAUCAU | 212 | 3883-3903 | AUGAUGGCAAAGAAGAUAGAAGC | 571 | 3881-3903 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136170.1 | UCUAUCUUCUUUGCCAUCAAU | 213 | 3884-3904 | AUUGAUGGCAAAGAAGAUAGAAG | 572 | 3882-3904 |
| AD-1136171.1 | CUAUCUUCUUUGCCAUCAAAU | 214 | 3885-3905 | AUUUGAUGGCAAAGAAGAUAGAA | 573 | 3883-3905 |
| AD-1136172.1 | UAUCUUCUUUGCCAUCAAAGU | 215 | 3886-3906 | ACUUUGAUGGCAAAGAAGAUAGA | 574 | 3884-3906 |
| AD-1136173.1 | AUCUUCUUUGCCAUCAAAGAU | 216 | 3887-3907 | AUCUUGAUGGCAAAGAAGAUAG | 575 | 3885-3907 |
| AD-1136174.1 | CUUCUUUGCCAUCAAAGAUGU | 217 | 3889-3909 | ACAUCUUUGAUGGCAAAGAAGAU | 576 | 3887-3909 |
| AD-1136175.1 | GAGCUCAGCACACAGGUAAUU | 218 | 3924-3944 | AAUUACCUGUGUGCUGAGCUCGA | 577 | 3922-3944 |
| AD-1136176.1 | CUCAGCACACAGGUAAUAACU | 219 | 3927-3947 | AGUUAUUACCUGUGUGCUGAGCU | 578 | 3925-3947 |
| AD-1136177.1 | UCAGCACACAGGUAAUAACGU | 220 | 3928-3948 | ACGUUAUUACCUGUGUGCUGAGC | 579 | 3926-3948 |
| AD-1136178.1 | CAGCACACAGGUAAUAACGUU | 221 | 3929-3949 | AACGUUAUUACCUGUGUGCUGAG | 580 | 3927-3949 |
| AD-1136179.1 | ACAGGUAAUAACGUGAAGGAU | 222 | 3935-3955 | AUCCUUCACGUUAUUACCUGUGU | 581 | 3933-3955 |
| AD-1136180.1 | CAGGUAAUAACGUGAAGGAAU | 223 | 3936-3956 | AUUCCUUCACGUUAUUACCUGUG | 582 | 3934-3956 |
| AD-1136181.1 | AGGUAAUAACGUGAAGGAACU | 224 | 3937-3957 | AGUUCCUUCACGUUAUUACCUGU | 583 | 3935-3957 |
| AD-1136182.1 | AUAACGUGAAGGAACUCUUCU | 225 | 3942-3962 | AGAAGAGUUCCUUCACGUUAUUA | 584 | 3940-3962 |
| AD-1136183.1 | UAACGUGAAGGAACUCUUCCU | 226 | 3943-3963 | AGGAAGAGUUCCUUCACGUUAUU | 585 | 3941-3963 |
| AD-1136184.1 | CCCAGAAAACUGCAAACCCUU | 227 | 4042-4062 | AAGGGUUGCAGUUUUCUGGGAC | 586 | 4040-4062 |
| AD-1136185.1 | CACAGAACAUGGAUCUAUUAU | 228 | 4145-4165 | AUAAUAGAUCCAUGUUCUGUGGU | 587 | 4143-4165 |
| AD-1136186.1 | ACAGAACAUGGAUCUAUUAAU | 229 | 4146-4166 | AUUAAUAGAUCCAUGUUCUGUGG | 588 | 4144-4166 |
| AD-1136187.1 | CAGAACAUGGAUCUAUUAAAU | 230 | 4147-4167 | AUUUAAUAGAUCCAUGUUCUGUG | 589 | 4145-4167 |
| AD-1136188.1 | AGAACAUGGAUCUAUUAAAGU | 231 | 4148-4168 | ACUUUAAUAGAUCCAUGUUCUGU | 590 | 4146-4168 |
| AD-1136189.1 | GAACAUGGAUCUAUUAAAGUU | 232 | 4149-4169 | AACUUUAAUAGAUCCAUGUUCUG | 591 | 4147-4169 |
| AD-1136190.1 | AACAUGGAUCUAUUAAAGUCU | 233 | 4150-4170 | AGACUUUAAUAGAUCCAUGUUCU | 592 | 4148-4170 |
| AD-1136191.1 | ACAUGGAUCUAUUAAAGUCAU | 234 | 4151-4171 | AUGACUUAAUAGAUCCAUGUUC | 593 | 4149-4171 |
| AD-1136192.1 | CAUGGAUCUAUUAAAGUCACU | 235 | 4152-4172 | AGUGACUUUAAUAGAUCCAUGUU | 594 | 4150-4172 |
| AD-1136193.1 | AUGGAUCUAUUAAAGUCACAU | 236 | 4153-4173 | AUGUGACUUUAAUAGAUCCAUGU | 595 | 4151-4173 |
| AD-1136194.1 | UGGAUCUAUUAAAGUCACAGU | 237 | 4154-4174 | ACUGTGACUUUAAUAGAUCCAUG | 596 | 4152-4174 |
| AD-1136195.1 | GGAUCUAUUAAAGUCACAGAU | 238 | 4155-4175 | AUCUGUGACUUUAAUAGAUCCAU | 597 | 4153-4175 |
| AD-1136196.1 | GAUCUAUUAAAGUCACAGAAU | 239 | 4156-4176 | AUUCUGTGACUUUAAUAGAUCCA | 598 | 4154-4176 |
| AD-1136197.1 | ACAAUGAUAAGCAAAUUCAAU | 240 | 4261-4281 | AUUGAAUUUGCUUAUCAUUGUGU | 599 | 4259-4281 |
| AD-1136198.1 | CAAUGAUAAGCAAAUUCAAAU | 241 | 4262-4282 | AUUUGAAUUUGCUUAUCAUUGUG | 600 | 4260-4282 |
| AD-1136199.1 | AUGAUAAGCAAAUUCAAAACU | 242 | 4264-4284 | AGUUUGAAUUUGCUUAUCAUUG | 601 | 4262-4284 |
| AD-1136200.1 | AUGCCUAAAUGGUGAAUAUGU | 243 | 4288-4308 | ACAUAUUCACCAUUUAGGCAUAA | 602 | 4286-4308 |
| AD-1136201.1 | UGCCUAAAUGGUGAAUAUGCU | 244 | 4289-4309 | AGCAUAUUCACCAUUUAGGCAUA | 603 | 4287-4309 |
| AD-1136202.1 | GCCUAAAUGGUGAAUAUGCAU | 245 | 4290-4310 | AUGCAUAUUCACCAUUUAGGCAU | 604 | 4288-4310 |
| AD-1136203.1 | CCUAAAUGGUGAAUAUGCAAU | 246 | 4291-4311 | AUUGCATAUUCACCAUUUAGGCA | 605 | 4289-4311 |
| AD-1136204.1 | CUAAAUGGUGAAUAUGCAAUU | 247 | 4292-4312 | AAUUGCAUAUUCACCAUUUAGGC | 606 | 4290-4312 |
| AD-1136205.1 | AAUGGUGAAUAUGCAAUUAGU | 248 | 4295-4315 | ACUAAUUGCAUAUUCACCAUUUA | 607 | 4293-4315 |
| AD-1136206.1 | CGGGAAGGGUUUGUGCUAUUU | 249 | 4357-4377 | AAAUAGCACAAACCCUUCCCGAC | 608 | 4355-4377 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136207.1 | GGGAAGGGUUUGUGCUAUUCU | 250 | 4358-4378 | AGAAUAGCACAAACCCUUCCCGA | 609 | 4356-4378 |
| AD-1136208.1 | GGAAGGGUUUGUGCUAUUCCU | 251 | 4359-4379 | AGGAAUAGCACAAACCCUUCCCG | 610 | 4357-4379 |
| AD-1136209.1 | GUAUAACCUCAAGUUCUGAUU | 252 | 4397-4417 | AAUCAGAACUUGAGGUUAUACAG | 611 | 4395-4417 |
| AD-1136210.1 | UAUAACCUCAAGUUCUGAUGU | 253 | 4398-4418 | ACAUCAGAACUUGAGGUUAUACA | 612 | 4396-4418 |
| AD-1136211.1 | CCUCAAGUUCUGAUGGUGUCU | 254 | 4403-4423 | AGACACCAUCAGAACUUGAGGUU | 613 | 4401-4423 |
| AD-1136212.1 | CAAGUUCUGAUGGUGUCUGUU | 255 | 4406-4426 | AACAGACACCAUCAGAACUUGAG | 614 | 4404-4426 |
| AD-1136213.1 | CCACAAACCUCUAGAAGCUUU | 256 | 4442-4462 | AAAGCUUCUAGAGGUUUGUGGGA | 615 | 4440-4462 |
| AD-1136214.1 | ACAAACCUCUAGAAGCUUUAU | 257 | 4444-4464 | AUUAAGCUUCUAGAGGUUUGUGG | 616 | 4442-4464 |
| AD-1136215.1 | AAACCUCUAGAAGCUUUAACU | 258 | 4446-4466 | AGUUUAAGCUUCUAGAGGUUUGU | 617 | 4444-4466 |
| AD-1136216.1 | AACCUCUAGAAGCUUUAACCU | 259 | 4447-4467 | AGGUUUAAGCUUCUAGAGGUUUG | 618 | 4445-4467 |
| AD-1136217.1 | UGGCCUUCAAACCAAUGAACU | 260 | 4504-4524 | AGUUCAUUGGUUUGAAGGCCAGG | 619 | 4502-4524 |
| AD-1136218.1 | GGCCUUCAAACCAAUGAACAU | 261 | 4505-4525 | AUGUUCAUUGGUUUGAAGGCCAG | 620 | 4503-4525 |
| AD-1136219.1 | GCCUUCAAACCAAUGAACAGU | 262 | 4506-4526 | ACUGUUCAUUGGUUUGAAGGCCA | 621 | 4504-4526 |
| AD-1136220.1 | UCAAACCAAUGAACAGCAAAU | 263 | 4510-4530 | AUUUGCUGUUCAUUGGUUUGAAG | 622 | 4508-4530 |
| AD-1136221.1 | GAACAGCAAAGCAUAACCUUU | 264 | 4520-4540 | AAAGGUUAUGCUUUGCUGUUCAU | 623 | 4518-4540 |
| AD-1136222.1 | AACAGCAAAGCAUAACCUUGU | 265 | 4521-4541 | ACAAGGUUAUGCUUUGCUGUUCA | 624 | 4519-4541 |
| AD-1136223.1 | AGCAAAGCAUAACCUUGAAUU | 266 | 4524-4544 | AAUUCAAGGUUAUGCUUUGCUGU | 625 | 4522-4544 |
| AD-1136224.1 | GCAAAGCAUAACCUUGAAUCU | 267 | 4525-4545 | AGAUUCAAGGUUAUGCUUUGCUG | 626 | 4523-4545 |
| AD-1136225.1 | CAAAGCAUAACCUUGAAUCUU | 268 | 4526-4546 | AAGAUUCAAGGUUAUGCUUUGCU | 627 | 4524-4546 |
| AD-1136226.1 | GCAUAACCUUGAAUCUAUACU | 269 | 4530-4550 | AGUAUAGAUUCAAGGUUAUGCUU | 628 | 4528-4550 |
| AD-1136227.1 | CAUAACCUUGAAUCUAUACUU | 270 | 4531-4551 | AAGUAUAGAUUCAAGGUUAUGCU | 629 | 4529-4551 |
| AD-1136228.1 | AUAACCUUGAAUCUAUACUCU | 271 | 4532-4552 | AGAGUAUAGAUUCAAGGUUAUGC | 630 | 4530-4552 |
| AD-1136229.1 | UAACCUUGAAUCUAUACUCAU | 272 | 4533-4553 | AUGAGUAUAGAUUCAAGGUUAUG | 631 | 4531-4553 |
| AD-1136230.1 | AACCUUGAAUCUAUACUCAAU | 273 | 4534-4554 | AUUGAGUAUAGAUUCAAGGUUAU | 632 | 4532-4554 |
| AD-1136231.1 | ACCUUGAAUCUAUACUCAAAU | 274 | 4535-4555 | AUUUGAGUAUAGAUUCAAGGUUA | 633 | 4533-4555 |
| AD-1136232.1 | CCUUGAAUCUAUACUCAAAUU | 275 | 4536-4556 | AAUUUGAGUAUAGAUUCAAGGUU | 634 | 4534-4556 |
| AD-1136233.1 | AAUCUAUACUCAAAUUUUGCU | 276 | 4541-4561 | AGCAAAAUUUGAGUAUAGAUUCA | 635 | 4539-4561 |
| AD-1136234.1 | AUCUAUACUCAAAUUUUGCAU | 277 | 4542-4562 | AUGCAAAAUUUGAGUAUAGAUUC | 636 | 4540-4562 |
| AD-1136235.1 | GGUUAAAUCCUCUAACCAUCU | 278 | 4579-4599 | AGAUGGUUAGAGGAUUUAACCUU | 637 | 4577-4599 |
| AD-1136236.1 | UAAAUCCUCUAACCAUCUUUU | 279 | 4582-4602 | AAAAGAUGGUUAGAGGAUUUAAC | 638 | 4580-4602 |
| AD-1136237.1 | AAAUCCUCUAACCAUCUUUGU | 280 | 4583-4603 | ACAAAGAUGGUUAGAGGAUUUAA | 639 | 4581-4603 |
| AD-1136238.1 | AAUCCUCUAACCAUCUUUGAU | 281 | 4584-4604 | AUCAAAGAUGGUUAGAGGAUUUA | 640 | 4582-4604 |
| AD-1136239.1 | AUCCUCUAACCAUCUUUGAAU | 282 | 4585-4605 | AUUCAAAGAUGGUUAGAGGAUUU | 641 | 4583-4605 |
| AD-1136240.1 | UCCUCUAACCAUCUUUGAAUU | 283 | 4586-4606 | AAUUCAAAGAUGGUUAGAGGAUU | 642 | 4584-4606 |
| AD-1136241.1 | CCUCUAACCAUCUUUGAAUCU | 284 | 4587-4607 | AGAUUCAAAGAUGGUUAGAGGAU | 643 | 4585-4607 |
| AD-1136242.1 | CUCUAACCAUCUUUGAAUCAU | 285 | 4588-4608 | AUGAUUCAAAGAUGGUUAGAGGA | 644 | 4586-4608 |
| AD-1136243.1 | UCUAACCAUCUUUGAAUCAUU | 286 | 4589-4609 | AAUGAUUCAAAGAUGGUUAGAGG | 645 | 4587-4609 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136244.1 | CUAACCAUCUUUGAAUCAUUU | 287 | 4590-4610 | AAAUGAUCAAAGAUGGUUAGAG | 646 | 4588-4610 |
| AD-1136245.1 | UAACCAUCUUUGAAUCAUUGU | 288 | 4591-4611 | ACAAUGAUUCAAAGAUGGUUAGA | 647 | 4589-4611 |
| AD-1136246.1 | AACCAUCUUUGAAUCAUUGGU | 289 | 4592-4612 | ACCAAUGAUUCAAAGAUGGUUAG | 648 | 4590-4612 |
| AD-1136247.1 | CCAUCUUUGAAUCAUUGGAAU | 290 | 4594-4614 | AUUCCAAUGAUUCAAAGAUGGUU | 649 | 4592-4614 |
| AD-1136248.1 | CAUCUUUGAAUCAUUGGAAAU | 291 | 4595-4615 | AUUUCCAAUGAUUCAAAGAUGGU | 650 | 4593-4615 |
| AD-1136249.1 | AUCUUUGAAUCAUUGGAAAGU | 292 | 4596-4616 | ACUUCCAAUGAUUCAAAGAUGG | 651 | 4594-4616 |
| AD-1136250.1 | CUUUGAAUCAUUGGAAAGAAU | 293 | 4598-4618 | AUUCUUCCAAUGAUUCAAAGAU | 652 | 4596-4618 |
| AD-1136251.1 | GAAAGAAUAAAGAAUGAAACU | 294 | 4611-4631 | AGUUUCAUUCUUUAUUCUUUCCA | 653 | 4609-4631 |
| AD-1136252.1 | AAAGAAUAAAGAAUGAAACAU | 295 | 4612-4632 | AUGUUCAUUCUUUAUUCUUUCC | 654 | 4610-4632 |
| AD-1136253.1 | GAAUGAAACAAAUUCAAGGUU | 296 | 4622-4642 | AACCUUGAAUUUGUUUCAUUCUU | 655 | 4620-4642 |
| AD-1136254.1 | AUGAAACAAAUUCAAGGUUAU | 297 | 4624-4644 | AUAACCUGAAUUUGUUUCAUUC | 656 | 4622-4644 |
| AD-1136255.1 | AACAAAUUCAAGGUUAAUUGU | 298 | 4628-4648 | ACAAUUAACCUUGAAUUUGUUUC | 657 | 4626-4648 |
| AD-1136256.1 | UGAAGCUGCAUAAAGCAAGAU | 299 | 4660-4680 | AUCUUGCUUUAUGCAGCUUCACA | 658 | 4658-4680 |
| AD-1136257.1 | AAGCUGCAUAAAGCAAGAUUU | 300 | 4662-4682 | AAAUCUGCUUUAUGCAGCUUCA | 659 | 4660-4682 |
| AD-1136258.1 | AGCUGCAUAAAGCAAGAUUAU | 301 | 4663-4683 | AUAAUCUGCUUUAUGCAGCUUC | 660 | 4661-4683 |
| AD-1136259.1 | GCUGCAUAAAGCAAGAUUACU | 302 | 4664-4684 | AGUAAUCUUGCUUUAUGCAGCUU | 661 | 4662-4684 |
| AD-1136260.1 | CUGCAUAAAGCAAGAUUACUU | 303 | 4665-4685 | AAGUAAUCUUGCUUUAUGCAGCU | 662 | 4663-4685 |
| AD-1136261.1 | UGCAUAAAGCAAGAUUACUCU | 304 | 4666-4686 | AGAGUAAUCUUGCUUUAUGCAGC | 663 | 4664-4686 |
| AD-1136262.1 | CAUAAAGCAAGAUUACUCUAU | 305 | 4668-4688 | AUAGAGUAAUCUUGCUUUAUGCA | 664 | 4666-4688 |
| AD-1136263.1 | UAAAGCAAGAUUACUCUAUAU | 306 | 4670-4690 | AUAUAGAGUAAUCUUGCUUUAUG | 665 | 4668-4690 |
| AD-1136264.1 | AUACAAAAAUCCAACCAACUU | 307 | 4690-4710 | AAGUUGGUUGGAUUUUUGUAUUA | 666 | 4688-4710 |
| AD-1136265.1 | UACAAAAAUCCAACCAACUCU | 308 | 4691-4711 | AGAGUUGGUUGGAUUUUUGUAUU | 667 | 4689-4711 |
| AD-1136266.1 | ACAAAAAUCCAACCAACUCAU | 309 | 4692-4712 | AUGAGUUGGUUGGAUUUUUGUAU | 668 | 4690-4712 |
| AD-1136267.1 | CAAAAAUCCAACCAACUCAAU | 310 | 4693-4713 | AUUGAGUUGGUUGGAUUUUUGUA | 669 | 4691-4713 |
| AD-1136268.1 | AAAAAUCCAACCAACUCAAUU | 311 | 4694-4714 | AAUUGAGUUGGUUGGAUUUUUGU | 670 | 4692-4714 |
| AD-1136269.1 | AAAAUCCAACCAACUCAAUUU | 312 | 4695-4715 | AAAUUGAGUUGGUUGGAUUUUUG | 671 | 4693-4715 |
| AD-1136270.1 | AAAUCCAACCAACUCAAUUAU | 313 | 4696-4716 | AUAAUUGAGUUGGUUGGAUUUUU | 672 | 4694-4716 |
| AD-1136271.1 | AAUCCAACCAACUCAAUUAUU | 314 | 4697-4717 | AAUAAUUGAGUUGGUUGGAUUUU | 673 | 4695-4717 |
| AD-1136272.1 | AUCCAACCAACUCAAUUAUUU | 315 | 4698-4718 | AAAUAAUUGAGUUGGUUGGAUUU | 674 | 4696-4718 |
| AD-1136273.1 | UCCAACCAACUCAAUUAUUGU | 316 | 4699-4719 | ACAAUAAUUGAGUUGGUUGGAUU | 675 | 4697-4719 |
| AD-1136274.1 | CCAACCAACUCAAUUAUUGAU | 317 | 4700-4720 | AUCAAUAAUUGAGUUGGUUGGAU | 676 | 4698-4720 |
| AD-1136275.1 | CAACCAACUCAAUUAUUGAGU | 318 | 4701-4721 | ACUCAAUAAUUGAGUUGGUUGGA | 677 | 4699-4721 |
| AD-1136276.1 | AACCAACUCAAUUAUUGAGCU | 319 | 4702-4722 | AGCUCAAUAAUUGAGUUGGUUGG | 678 | 4700-4722 |
| AD-1136277.1 | ACCAACUCAAUUAUUGAGCAU | 320 | 4703-4723 | AUGCUCAAUAAUUGAGUUGGUUG | 679 | 4701-4723 |
| AD-1136278.1 | CCAACUCAAUUAUUGAGCACU | 321 | 4704-4724 | AGUGCUCAAUAAUUGAGUUGGUU | 680 | 4702-4724 |
| AD-1136279.1 | CGUACAAUGUUCUAGAUUUCU | 322 | 4723-4743 | AGAAAUCUAGAACAUUGUACGUG | 681 | 4721-4743 |
| AD-1136280.1 | GUACAAUGUUCUAGAUUUCUU | 323 | 4724-4744 | AAGAAAUCUAGAACAUUGUACGU | 682 | 4722-4744 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136281.1 | UACAAUGUUCUAGAUUUCUUU | 324 | 4725-4745 | AAAGAAAUCUAGAACAUUGUACG | 683 | 4723-4745 |
| AD-1136282.1 | ACAAUGUUCUAGAUUUCUUUU | 325 | 4726-4746 | AAAAGAAAUCUAGAACAUUGUAC | 684 | 4724-4746 |
| AD-1136283.1 | CAAUGUUCUAGAUUUCUUUCU | 326 | 4727-4747 | AGAAAGAAAUCUAGAACAUUGUA | 685 | 4725-4747 |
| AD-1136284.1 | AAUGUUCUAGAUUUCUUUCCU | 327 | 4728-4748 | AGGAAAGAAAUCUAGAACAUUGU | 686 | 4726-4748 |
| AD-1136285.1 | GUUCUAGAUUUCUUUCCCUUU | 328 | 4731-4751 | AAAGGGAAAGAAAUCUAGAACAU | 687 | 4729-4751 |
| AD-1136286.1 | UUCUAGAUUUCUUUCCCUUCU | 329 | 4732-4752 | AGAAGGGAAAGAAAUCUAGAACA | 688 | 4730-4752 |
| AD-1136287.1 | UCUUUACAUUUGAAGCCAAAU | 330 | 4817-4837 | AUUUGGCUUCAAAUGUAAAGAUU | 689 | 4815-4837 |
| AD-1136288.1 | CUUUACAUUUGAAGCCAAAGU | 331 | 4818-4838 | ACUUUGGCUUCAAAUGUAAAGAU | 690 | 4816-4838 |
| AD-1136289.1 | UUUACAUUUGAAGCCAAAGUU | 332 | 4819-4839 | AACUUGGCUUCAAAUGUAAAGA | 691 | 4817-4839 |
| AD-1136290.1 | ACAUUUGAAGCCAAAGUAAUU | 333 | 4822-4842 | AAUUACUUUGGCUUCAAAUGUAA | 692 | 4820-4842 |
| AD-1136291.1 | AUUUGAAGCCAAAGUAAUUUU | 334 | 4824-4844 | AAAAUUACUUUGGCUUCAAAUGU | 693 | 4822-4844 |
| AD-1136292.1 | GAAGCCAAAGUAAUUUCCACU | 335 | 4828-4848 | AGUGGAAAUUACUUUGGCUUCAA | 694 | 4826-4848 |
| AD-1136293.1 | AAGCCAAAGUAAUUUCCACCU | 336 | 4829-4849 | AGGUGGAAAUUACUUUGGCUUCA | 695 | 4827-4849 |
| AD-1136294.1 | CCAAAGUAAUUUCCACCUAGU | 337 | 4832-4852 | ACUAGGTGGAAAUUACUUUGGCU | 696 | 4830-4852 |
| AD-1136295.1 | CAAAGUAAUUUCCACCUAGAU | 338 | 4833-4853 | AUCUAGGUGGAAAUUACUUUGGC | 697 | 4831-4853 |
| AD-1136296.1 | AAAGUAAUUUCCACCUAGAAU | 339 | 4834-4854 | AUUCUAGGUGGAAAUUACUUUGG | 698 | 4832-4854 |
| AD-1136297.1 | GCAAGAUCUUGUCUCUGAAGU | 340 | 5134-5154 | ACUUCAGAGACAAGAUCUUGCUC | 699 | 5132-5154 |
| AD-1136298.1 | AGGUAGAAGAGCCAAGAAGCU | 341 | 5201-5221 | AGCUUCUUGGCUCUUCUACCUCU | 700 | 5199-5221 |
| AD-1136299.1 | CUAGCUCUGUCUCUUCUGUCU | 342 | 5234-5254 | AGACAGAAGAGACAGAGCUAGGA | 701 | 5232-5254 |
| AD-1136300.1 | UAGCUCUGUCUCUUCUGUCUU | 343 | 5235-5255 | AAGACAGAAGAGACAGAGCUAGG | 702 | 5233-5255 |
| AD-1136301.1 | AGCUCUGUCUCUUCUGUCUCU | 344 | 5236-5256 | AGAGACAGAAGAGACAGAGCUAG | 703 | 5234-5256 |
| AD-1136302.1 | AUCUUUGUGAUCUUGGACUGU | 345 | 5257-5277 | ACAGUCCAAGAUCACAAAGAUAG | 704 | 5255-5277 |
| AD-1136303.1 | CUUCCGUGAUCCAUUUUACU | 346 | 5286-5306 | AGUAAAAUGGAUCACAGGAAGGG | 705 | 5284-5306 |
| AD-1136304.1 | UUCCUGUGAUCCAUUUUACUU | 347 | 5287-5307 | AAGUAAAAUGGAUCACAGGAAGG | 706 | 5285-5307 |
| AD-1136305.1 | UCCUGUGAUCCAUUUUACUGU | 348 | 5288-5308 | ACAGUAAAAUGGAUCACAGGAAG | 707 | 5286-5308 |
| AD-1136306.1 | CCUGUGAUCCAUUUUACUGCU | 349 | 5289-5309 | AGCAGUAAAAUGGAUCACAGGAA | 708 | 5287-5309 |
| AD-1136307.1 | CUGUGAUCCAUUUUACUGCAU | 350 | 5290-5310 | AUGCAGUAAAAUGGAUCACAGGA | 709 | 5288-5310 |
| AD-1136308.1 | CUAUAAAUAUGACCUGAAU | 351 | 5360-5380 | AUUCAGGUCAUAUAUUUAUAGGC | 710 | 5358-5380 |
| AD-1136309.1 | UGACCUGAAAACUCCAGUUAU | 352 | 5371-5391 | AUAACUGGAGUUUUCAGGUCAUA | 711 | 5369-5391 |
| AD-1136310.1 | GACCUGAAAACUCCAGUUACU | 353 | 5372-5392 | AGUAACTGGAGUUUUCAGGUCAU | 712 | 5370-5392 |
| AD-1136311.1 | AAGGAUCUGCAGCUAUCUAAU | 354 | 5395-5415 | AUUAGAUAGCUGCAGAUCCUUUA | 713 | 5393-5415 |
| AD-1136312.1 | AGGAUCUGCAGCUAUCUAAGU | 355 | 5396-5416 | ACUUAGAUAGCUGCAGAUCCUUU | 714 | 5394-5416 |
| AD-1136313.1 | GCUAUCUAAGGCUUGGUUUUU | 356 | 5406-5426 | AAAAACCAAGCCUUAGAUAGCUG | 715 | 5404-5426 |
| AD-1136314.1 | CUAUCUAAGGCUUGGUUUUCU | 357 | 5407-5427 | AGAAAACCAAGCCUUAGAUAGCU | 716 | 5405-5427 |
| AD-1136315.1 | AUCUAAGGCUUGGUUUUCUUU | 358 | 5409-5429 | AAAGAAAACCAAGCCUUAGAUAG | 717 | 5407-5429 |
| AD-1136316.1 | UCUAAGGCUUGGUUUUCUUAU | 359 | 5410-5430 | AUAAGAAAACCAAGCCUUAGAUA | 718 | 5408-5430 |
| AD-1136317.1 | CUAAGGCUUGGUUUUCUUACU | 360 | 5411-5431 | AGUAAGAAAACCAAGCCUUAGAU | 719 | 5409-5431 |

TABLE 2-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136318.1 | UAAGGCUUGGUUUUCUUACUU | 361 | 5412-5432 | AAGUAAGAAAACCAAGCCUUAGA | 720 | 5410-5432 |
| AD-1136319.1 | GGCUUGGUUUUCUUACUGUCU | 362 | 5415-5435 | AGACAGUAAGAAAACCAAGCCUU | 721 | 5413-5435 |
| AD-1136320.1 | GCUUGGUUUUCUUACUGUCAU | 363 | 5416-5436 | AUGACAGUAAGAAAACCAAGCCU | 722 | 5414-5436 |
| AD-1136321.1 | CUUGGUUUUCUUACUGUCAUU | 364 | 5417-5437 | AAUGACAGUAAGAAAACCAAGCC | 723 | 5415-5437 |
| AD-1136322.1 | UUGGUUUUCUUACUGUCAUAU | 365 | 5418-5438 | AUAUGACAGUAAGAAAACCAAGC | 724 | 5416-5438 |
| AD-1136323.1 | UGGUUUUCUUACUGUCAUAUU | 366 | 5419-5439 | AAUAUGACAGUAAGAAAACCAAG | 725 | 5417-5439 |
| AD-1136324.1 | GGUUUUCUUACUGUCAUAUGU | 367 | 5420-5440 | ACAUAUGACAGUAAGAAAACCAA | 726 | 5418-5440 |
| AD-1136325.1 | UUUUCUUACUGUCAUAUGAUU | 368 | 5422-5442 | AAUCAUAUGACAGUAAGAAAACC | 727 | 5420-5442 |
| AD-1136326.1 | UUUCUUACUGUCAUAUGAUAU | 369 | 5423-5443 | AUAUCAUAUGACAGUAAGAAAAC | 728 | 5421-5443 |
| AD-1136327.1 | UCUUACUGUCAUAUGAUACCU | 370 | 5425-5445 | AGGUAUCAUAUGACAGUAAGAAA | 729 | 5423-5445 |
| AD-1136328.1 | CUUACUGUCAUAUGAUACCUU | 371 | 5426-5446 | AAGGUAUCAUAUGACAGUAAGAA | 730 | 5424-5446 |
| AD-1136329.1 | UCUGCGGUUGGUAAAGAGAAU | 372 | 5481-5501 | AUUCUCUUUACCAACCGCAGAAA | 731 | 5479-5501 |
| AD-1136330.1 | UGGUGAUUUAAUCCCUACAUU | 373 | 5537-5557 | AAUGUAGGGAUUAAAUCACCAUU | 732 | 5535-5557 |
| AD-1136331.1 | GGUGAUUUAAUCCCUACAUGU | 374 | 5538-5558 | ACAUGUAGGGAUUAAAUCACCAU | 733 | 5536-5558 |
| AD-1136332.1 | UGUAUAAAUCCAACCUUCUGU | 375 | 5597-5617 | ACAGAAGGUUGGAUUUAUACAGU | 734 | 5595-5617 |
| AD-1136333.1 | GUGCUUGAUGUCACUAAUAAU | 376 | 5679-5699 | AUUAUUAGUGACAUCAAGCACCA | 735 | 5677-5699 |
| AD-1136334.1 | UGCUUGAUGUCACUAAUAAAU | 377 | 5680-5700 | AUUUAUUAGUGACAUCAAGCACC | 736 | 5678-5700 |
| AD-1136335.1 | GCUUGAUGUCACUAAUAAAUU | 378 | 5681-5701 | AAUUUAUUAGUGACAUCAAGCAC | 737 | 5679-5701 |
| AD-1136336.1 | AUGUCACUAAUAAAUGAAACU | 379 | 5686-5706 | AGUUCAUUUAUUAGUGACAUCA | 738 | 5684-5706 |
| AD-1136337.1 | UGUCACUAAUAAAUGAAACUU | 380 | 5687-5707 | AAGUUCAUUUAUUAGUGACAUC | 739 | 5685-5707 |
| AD-1136338.1 | UAAUAAAUGAAACUGUCAGCU | 381 | 5693-5713 | AGCUGACAGUUUCAUUUAUUAGU | 740 | 5691-5713 |

TABLE 3

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1135979.1 | usasccugCfcAfGfUfgucucuuaguL96 | 741 | asCfsuaaGfagacacuGfgCfagguasgsu | 1100 | ACUACCUGCCAGUGUCUCUUAGG | 1459 |
| AD-1135980.1 | ascscugcCfaGfUfGfucucuuagauL96 | 742 | asCfscuaAfgagacacUfgGfcaggusasg | 1101 | CUACCUGCCAGUGUCUCUUAGGA | 1460 |
| AD-1135981.1 | cscsugccAfgUfGfUfcucuuaggauL96 | 743 | asUfsccuAfagagacaCfuGfgcaggsusa | 1102 | UACCUGCCAGUGUCUCUUAGGAG | 1461 |
| AD-1135982.1 | usgsccagUfgUfCfUfcuuaggaguuL96 | 744 | asAfscucCfuaagagaCfaCfuggcasgsg | 1103 | CCUGCCAGUGUCUCUUAGGAGUG | 1462 |
| AD-1135983.1 | gscscaguGfuCfUfCfuuaggagugL96 | 745 | asCfsacdTc(C2p)uaagagAfcAfcuggcsasg | 1104 | CUGCCAGUGUCUCUUAGGAGUGA | 1463 |
| AD-1135984.1 | cscsagugUfcUfCfUfuaggagugauL96 | 746 | asUfscadCu(C2p)cuaagaGfaCfacuggscsa | 1105 | UGCCAGUGUCUCUUAGGAGUGAG | 1464 |
| AD-1135985.1 | csasgugUfcUfCfUfUfaggagugauL96 | 747 | asCfsucaCfuccuaagAfgAfcacugsgsc | 1106 | GCCAGUGUCUCUUAGGAGUGAGG | 1465 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1135986.1 | asgsugucUfcUfUfAfggaguga gguL96 | 748 | asCfscucAfcuccuaaGfaGfacacusgs g | 1107 | CCAGUGUCUCUUAGGAGUGAG GU | 1466 |
| AD-1135987.1 | usgsgagaAfaAfAfUfgcagaucc auL96 | 749 | asUfsggdAu(C2p)ugcauuUfuUfcuc cascsc | 1108 | GGUGGAGAAAAAUGCAGAUC CAG | 1467 |
| AD-1135988.1 | cscsagagAfcAfAfCfccuuuugg cuL96 | 750 | asGfsccaAfaagggguuGfuCfucuggsas u | 1109 | AUCCAGAGACAACCCUUUUGG CC | 1468 |
| AD-1135989.1 | asgsagacAfaCfCfCfuuuuggcc uuL96 | 751 | asAfsggdCc(Agn)aaagggUfuGfucu cusgsg | 1110 | CCAGAGACAACCCUUUUGGCC UA | 1469 |
| AD-1135990.1 | gscsacagUfgAfUfGfcucuccaa guL96 | 752 | asCfsuudGg(Agn)gagcauCfaCfugu gcsasa | 1111 | UUGCACAGUGAUGCUCUCCAA GU | 1470 |
| AD-1135991.1 | csascaguGfaUfGfCfucuccaag uuL96 | 753 | asAfscudTg(G2p)agagcaUfcAfcug ugscsa | 1112 | UGCACAGUGAUGCUCUCCAAG UA | 1471 |
| AD-1135992.1 | gsasugcuCfuCfCfAfaguaugau cuL96 | 754 | asGfsaucAfuacuuggAfgAfgcaucsas c | 1113 | GUGAUGCUCUCCAAGUAUGAU CG | 1472 |
| AD-1135993.1 | asusgcucUfcCfAfAfguaugauc guL96 | 755 | asCfsgauCfauacuugGfaGfagcauscs a | 1114 | UGAUGCUCUCCAAGUAUGAUC GU | 1473 |
| AD-1135994.1 | usgscucuCfcAfAfGfuaugaucg uuL96 | 756 | asAfscgaUfcauacuuGfaGfagcasus c | 1115 | GAUGCUCUCCAAGUAUGAUCG UC | 1474 |
| AD-1135995.1 | gscsucucCfaAfGfUfaugaucgu cuL96 | 757 | asGfsacgAfucauacuUfgGfagagcsas u | 1116 | AUGCUCUCCAAGUAUGAUCGU CU | 1475 |
| AD-1135996.1 | csuscuccAfaGfUfAfugaucguc uuL96 | 758 | asAfsgacGfaucauacUfuGfgagagscs a | 1117 | UGCUCUCCAAGUAUGAUCGUC UG | 1476 |
| AD-1135997.1 | gsasucguCfuGfCfAfgaacaaga uuL96 | 759 | asAfsucdTu(G2p)uucugcAfgAfcga ucsasu | 1118 | AUGAUCGUCUGCAGAACAAGA UC | 1477 |
| AD-1135998.1 | csgsucugCfaGfAfAfcaagaucg uuL96 | 760 | asAfscgaUfcuuguucUfgCfagacgsas u | 1119 | AUCGUCUGCAGAACAAGAUCG UC | 1478 |
| AD-1135999.1 | gsuscugcAfgAfAfCfaagaucgu cuL96 | 761 | asGfsacgAfucuuguuCfuGfcagacsgs a | 1120 | UCGUCUGCAGAACAAGAUCGU CC | 1479 |
| AD-1136000.1 | uscsugcaGfaAfCfAfagaucguc cuL96 | 762 | asGfsgacGfaucuuguUfcUfgcagascs g | 1121 | CGUCUGCAGAACAAGAUCGUC CA | 1480 |
| AD-1136001.1 | gscsagaaCfaAfGfAfucguccac uuL96 | 763 | asAfsgudGg(Agn)cgaucuUfgUfucu gcsasg | 1122 | CUGCAGAACAAGAUCGUCCAC UU | 1481 |
| AD-1136002.1 | csasgaacAfaGfAfUfcguccacu uuL96 | 764 | asAfsagdTg(G2p)acgaucUfuGfuuc ugscsa | 1123 | UGCAGAACAAGAUCGUCCACU UU | 1482 |
| AD-1136003.1 | gsasacaaGfaUfCfGfuccacuuu uuL96 | 765 | asAfsaadAg(Tgn)ggacgaUfcUfugu ucsusg | 1124 | CAGAACAAGAUCGUCCACUUU UC | 1483 |
| AD-1136004.1 | asascaagAfuCfGfUfccacuuuu cuL96 | 766 | asGfsaaaAfguggacgAfuCfuuguuscs u | 1125 | AGAACAAGAUCGUCCACUUUU CU | 1484 |
| AD-1136005.1 | ascsaagaUfcGfUfCfcacuuuuc uuL96 | 767 | asAfsgaaAfaguggacGfaUfcuugusus c | 1126 | GAACAAGAUCGUCCACUUUUC UG | 1485 |
| AD-1136006.1 | csasagauCfgUfCfCfacuuuucu guL96 | 768 | asCfsagaAfaaguggaCfgAfucuugsus u | 1127 | AACAAGAUCGUCCACUUUUCU GC | 1486 |
| AD-1136007.1 | asasgaucGfuCfCfAfcuuuucug cuL96 | 769 | asGfscagAfaaaguggAfcGfaucuusgs u | 1128 | ACAAGAUCGUCCACUUUUCUG CC | 1487 |
| AD-1136008.1 | csgsuccaCfuUfUfUfcugccaau guL96 | 770 | asCfsaudTg(G2p)cagaaaAfgUfggac gsasu | 1129 | AUCGUCCACUUUUCUGCCAAU GC | 1488 |
| AD-1136009.1 | gsusccacUfuUfUfCfugccaaug cuL96 | 771 | asGfscadTu(G2p)gcagaaAfaGfugg acsgsa | 1130 | UCGUCCACUUUUCUGCCAAUG CC | 1489 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136010.1 | usgscuccUfuGfCfAfccauguugcuL96 | 772 | asGfscaaCfauggugcAfaGfgagcasgsa | 1131 | UCUGCUCCUUGCACCAUGUUGCA | 1490 |
| AD-1136011.1 | uscscuugCfaCfCfAfuguugcaguuL96 | 773 | asAfscudGc(Agn)acauggUfgCfaaggasgsc | 1132 | GCUCCUUGCACCAUGUUGCAGUG | 1491 |
| AD-1136012.1 | ususgcacCfaUfGfUfugcagugacuL96 | 774 | asGfsucdAc(Tgn)gcaacaUfgGfugcaasgsg | 1133 | CCUUGCACCAUGUUGCAGUGACA | 1492 |
| AD-1136013.1 | csasccauGfuUfGfCfagugacaacuL96 | 775 | asGfsuudGu(C2p)acugcaAfcAfuggugscsa | 1134 | UGCACCAUGUUGCAGUGACAACU | 1493 |
| AD-1136014.1 | ascscaugUfuGfCfAfgugacaacuuL96 | 776 | asAfsgudTg(Tgn)cacugcAfaCfauggusgsc | 1135 | GCACCAUGUUGCAGUGACAACUG | 1494 |
| AD-1136015.1 | asgsgagaGfaAfUfUfgccaaaagcuL96 | 777 | asGfscudTu(Tgn)ggcaaUfcCfuccusgsc | 1136 | GCAGGAGAAUUGCCAAAAGCC | 1495 |
| AD-1136016.1 | gsgsagagAfaUfUfGfccaaaagcuL96 | 778 | asGfsgcdTu(Tgn)uggcaaUfuCfucuccsusg | 1137 | CAGGAGAAUUGCCAAAAGCCA | 1496 |
| AD-1136017.1 | usgsgcauCfgUfCfAfugaguauguuL96 | 779 | asAfscauAfcucaugaCfgAfugccasgsg | 1138 | CCUGGCAUCGUCAUGAGUAUGUA | 1497 |
| AD-1136018.1 | gsgscaucGfuCfAfUfgaguauguaL96 | 780 | asUfsacdAu(Agn)cucaugAfcGfaugccsasg | 1139 | CUGGCAUCGUCAUGAGUAUGUAC | 1498 |
| AD-1136019.1 | gscsaucgUfcAfUfGfaguaugucuL96 | 781 | asGfsuacAfuacucauGfaCfgaugcscsa | 1140 | UGGCAUCGUCAUGAGUAUGUACA | 1499 |
| AD-1136020.1 | csasucguCfaUfGfAfguauguacauL96 | 782 | asUfsgudAc(Agn)uacucaUfgAfcgaugscsc | 1141 | GGCAUCGUCAUGAGUAUGUACAC | 1500 |
| AD-1136021.1 | asuscgucAfuGfAfGfuauguacacuL96 | 783 | asGfsugdTa(C2p)auacucAfuGfacgausgsc | 1142 | GCAUCGUCAUGAGUAUGUACACA | 1501 |
| AD-1136022.1 | csgsucauGfaGfUfAfuguacacacuL96 | 784 | asGfsugdTg(Tgn)acauacUfcCfugacgsasu | 1143 | AUCGUCAUGAGUAUGUACACACU | 1502 |
| AD-1136023.1 | gsuscaugAfgUfAfUfguacacacuuL96 | 785 | asAfsgudGu(G2p)uacauaCfuCfaugacsgsa | 1144 | UCGUCAUGAGUAUGUACACACUG | 1503 |
| AD-1136024.1 | uscsaugaGfuAfUfGfuacacacuguL96 | 786 | asCfsagdTg(Tgn)guacauAfcUfcaugascsg | 1145 | CGUCAUGAGUAUGUACACACUGC | 1504 |
| AD-1136025.1 | asasugccUfuCfCfAfaggaaaucuuL96 | 787 | asAfsgadTu(Tgn)ccuuggAfaGfgcauuscsu | 1146 | AGAAUGCCUUCCAAGGAAAUCUG | 1505 |
| AD-1136026.1 | asusgccuUfcCfCfAfAfggaaaucuguL96 | 788 | asCfsagaUfuuccuugGfaAfggcaususc | 1147 | GAAUGCCUUCCAAGGAAAUCUGU | 1506 |
| AD-1136027.1 | usgsccuuCfcCfAfAfGfgaaaucuguuL96 | 789 | asAfscagAfuuuccuuGfgAfaggcasusu | 1148 | AAUGCCUUCCAAGGAAAUCUGUG | 1507 |
| AD-1136028.1 | gscscuucCfaAfGfGfaaaucugugL96 | 790 | asCfsacaGfauuuccUfgGfaaggcsasu | 1149 | AUGCCUUCCAAGGAAAUCUGUGC | 1508 |
| AD-1136029.1 | cscsuuccAfaGfGfAfaaucugugcuL96 | 791 | asGfscacAfgauuccUfuGfgaaggscsa | 1150 | UGCCUUCCAAGGAAAUCUGUGCC | 1509 |
| AD-1136030.1 | gsasgaugAfaGfUfUfcaagaauauuL96 | 792 | asAfsuadTu(C2p)uugaacUfuCfaucucsasa | 1151 | UUGAGAUGAAGUUCAAGAAUAUG | 1510 |
| AD-1136031.1 | gsasugaaGfuUfCfAfagaauaugcuL96 | 793 | asGfscauAfuucuugaAfcUfucaucsusc | 1152 | GAGAUGAAGUUCAAGAAUAUGCU | 1511 |
| AD-1136032.1 | asasguucAfaGfAfAfuaugcuguuL96 | 794 | asAfsacdAg(C2p)auauucUfuGfaacuuscsa | 1153 | UGAAGUUCAAGAAUAUGCUGUUU | 1512 |
| AD-1136033.1 | asgsuucaAfgAfAfUfaugcuguuL96 | 795 | asAfsaadCa(G2p)cauauuCfuUfgaacussusc | 1154 | GAAGUUCAAGAAUAUGCUGUUUC | 1513 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136034.1 | gsusucaaGfaAfUfAfugcuguuucuL96 | 796 | asGfsaadAc(Agn)gcauauUfcUfugaacsusu | 1155 | AAGUUCAAGAAUAUGCUGUUUCC | 1514 |
| AD-1136035.1 | ususcaagAfaUfAfUfgcuguuuccuL96 | 797 | asGfsgaaAfcagcauaUfuCfuugaascsu | 1156 | AGUUCAAGAAUAUGCUGUUUCCU | 1515 |
| AD-1136036.1 | asasgaauAfuGfCfUfguuuccuauuL96 | 798 | asAfsuadGg(Agn)aacagcAfuAfuucuusgsa | 1157 | UCAAGAAUAUGCUGUUUCCUAUG | 1516 |
| AD-1136037.1 | gsgsgaguAfuUfUfCfucagcauucuL96 | 799 | asGfsaadTg(C2p)ugagaaAfuAfucccscsc | 1158 | GGGGGAGUAUUUCUCAGCAUUCA | 1517 |
| AD-1136038.1 | gsgsaguaUfuUfCfUfcagcauucauL96 | 800 | asUfsgadAu(G2p)cugagaAfaUfacuccscsc | 1159 | GGGGAGUAUUUCUCAGCAUUCAA | 1518 |
| AD-1136039.1 | gsasguaUfuCfUfCfUfagcauucauL96 | 801 | asUfsugaAfugcugagAfaAfuacucscsc | 1160 | GGGAGUAUUUCUCAGCAUUCAAG | 1519 |
| AD-1136040.1 | asgsuauUfcUfCfUfAfgcauucaaguL96 | 802 | asCfsuugAfaugcugaGfaAfauacuscsc | 1161 | GGAGUAUUUCUCAGCAUUCAAGC | 1520 |
| AD-1136041.1 | gsusauuuCfuCfUfAfGfcauucaagcuL96 | 803 | asGfscudTg(Agn)augcugAfgAfaaacsusc | 1162 | GAGUAUUUCUCAGCAUUCAAGCA | 1521 |
| AD-1136042.1 | gsusggcaUfgAfGfAfGfuuuuaucuL96 | 804 | asGfsaauAfaaacucuCfaUfgccacsusg | 1163 | CAGUGGCAUGAGAGUUUUAUUCA | 1522 |
| AD-1136043.1 | gsgscaugAfgAfGfUfuuuuauucaauL96 | 805 | asUfsugaAfuaaaacuCfuCfaugccsasc | 1164 | GUGGCAUGAGAGUUUUAUUCAAG | 1523 |
| AD-1136044.1 | csasugagAfgUfUfUfuauucaagcuL96 | 806 | asGfscudTg(Agn)auaaaaCfuCfucaugscsc | 1165 | GGCAUGAGAGUUUUAUUCAAGCC | 1524 |
| AD-1136045.1 | cscsucacCfcUfCfAfgcuucuucuuL96 | 807 | asAfsgaaGfaagcugaGfgGfugaggsgsu | 1166 | ACCCUCACCCUCAGCUUCUUCUU | 1525 |
| AD-1136046.1 | uscsaccCfUfCfAfGfCfuucucuucuL96 | 808 | asGfsaadGa(Agn)gaagcuGfaGfggugasgsg | 1167 | CCUCACCCUCAGCUUCUUCUUCA | 1526 |
| AD-1136047.1 | uscsuucaAfgUfUfCfuaccugacauL96 | 809 | asUfsgudCa(G2p)guagaaCfuUfgaagasasg | 1168 | CUUCUUCAAGUUCUACCUGACAG | 1527 |
| AD-1136048.1 | ususucgcCfaGfUfGfcaacuuuacuL96 | 810 | asGfsuaaAfguugcacUfgGfcgaaasgsu | 1169 | ACUUUCGCCAGUGCAACUUUACU | 1528 |
| AD-1136049.1 | ususcgccAfgUfGfCfaacuuuacuuL96 | 811 | asAfsguaAfaguugcaCfuGfgcgaaasasg | 1170 | CUUUCGCCAGUGCAACUUUACUG | 1529 |
| AD-1136050.1 | ususccagGfgUfUfUfguuuguuucuL96 | 812 | asGfsaaaCfaaacaaaCfcCfuggaascsc | 1171 | GGUUCCAGGGUUUGUUUGUUUCA | 1530 |
| AD-1136051.1 | csasggguUfuGfUfUfuguuucauuuL96 | 813 | asAfsaugAfaacaaacAfaAfcccugsgsa | 1172 | UCCAGGGUUUGUUUGUUUCAUUU | 1531 |
| AD-1136052.1 | gsgsguuuGfuUfUfGfuuucauuucuL96 | 814 | asGfsaaaUfgaaacaaAfcAfaacccsusg | 1173 | CAGGGUUUGUUUGUUUCAUUUCC | 1532 |
| AD-1136053.1 | gsgsuuugUfuUfGfUfuucauuuccuL96 | 815 | asGfsgaaAfugaaacaAfaCfaaaccscsu | 1174 | AGGGUUUGUUUGUUUCAUUUCCG | 1533 |
| AD-1136054.1 | ususguuuGfuUfUfCfauuuccgcuuL96 | 816 | asAfsgcgGfaaaugaaAfcAfaacaasasc | 1175 | GUUUGUUUGUUUCAUUUCCGCUG | 1534 |
| AD-1136055.1 | ususccugGfgAfGfUfaacauaacuuL96 | 817 | asAfsguuAfuguuacuCfcCfaggaascsa | 1176 | UGUUCCUGGGAGUAACAUAACUG | 1535 |
| AD-1136056.1 | gsgsgaguAfaCfAfUfaacuggaauL96 | 818 | asAfsuudCc(Agn)guuaugUfuAfcucccsasg | 1177 | CUGGGAGUAACAUAACUGGAAUU | 1536 |
| AD-1136057.1 | usasacauAfaCfUfGfgaauuugusauL96 | 819 | asUfsacaAfauuccagUfuAfuguuascsu | 1178 | AGUAACAUAACUGGAAUUUGUAA | 1537 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136058.1 | asascauaAfcUfGfGfaauuugua auL96 | 820 | asUfsuacAfaauuccaGfuUfauguusasc | 1179 | GUAACAUAACUGGAAUUUGU AAU | 1538 |
| AD-1136059.1 | csgsaaggAfuAfAfAfGfguuacuu guuL96 | 821 | asAfscaaGfuaaccuuAfuCfcuucgscsa | 1180 | UGCGAAGGAUAAGGUUACUU GUG | 1539 |
| AD-1136060.1 | gsasaggaUfaAfAfGfGfuuacuug uguL96 | 822 | asCfsacaAfguaaccuUfaUfccuucsgsc | 1181 | GCGAAGGAUAAGGUUACUUG UGU | 1540 |
| AD-1136061.1 | gsgsgugaAfaAfAfUfCfaccuauga auL96 | 823 | asUfsucaUfaggugauUfuUfcacccscsu | 1182 | AGGGGUGAAAAUCACCUAUG AAG | 1541 |
| AD-1136062.1 | asasucacCfuAfUfGfaagaacua cuL96 | 824 | asGfsuadGu(Tgn)cuucauAfgGfuga uususu | 1183 | AAAAUCACCUAUGAAGAACUA CC | 1542 |
| AD-1136063.1 | asuscaccUfaUfGfAfagaacuac cuL96 | 825 | asGfsgudAg(Tgn)ucuucaUfaGfgug aususu | 1184 | AAAUCACCUAUGAAGAACUAC CA | 1543 |
| AD-1136064.1 | usasccagCfcAfUfUfaucacaau uuL96 | 826 | asAfsaudTg(Tgn)gauaauGfgCfugg uasgsu | 1185 | ACUACCAGCCAUUAUCACAAU UG | 1544 |
| AD-1136065.1 | gsasacaaCfuCfCfUfuuuaugga cuL96 | 827 | asGfsuccAfuaaaaggAfgUfuguucsusu | 1186 | AAGAACAACUCCUUUUAUGGA CC | 1545 |
| AD-1136066.1 | gsgsccaaGfaGfCfAfcuucuacc uuL96 | 828 | asAfsgggdTa(G2p)aagugcUfcUfugg ccsasc | 1187 | GUGGCCAAGAGCACUUCUACC UG | 1546 |
| AD-1136067.1 | gsasgcacUfuCfUfAfccuggaga cuL96 | 829 | asGfsucdTc(C2p)agguagAfaGfugc ucsusu | 1188 | AAGAGCACUUCUACCUGGAGA CU | 1547 |
| AD-1136068.1 | gscsacuuCfuAfCfCfuggagacu cuL96 | 830 | asGfsagdTc(Tgn)ccagguAfgGfagu gcsusc | 1189 | GAGCACUUCUACCUGGAGACU CA | 1548 |
| AD-1136069.1 | csascuucUfaCfCfUfggagacuc auL96 | 831 | asUfsgadGu(C2p)uccaggUfaGfaag ugscsu | 1190 | AGCACUUCUACCUGGAGACUC AC | 1549 |
| AD-1136070.1 | uscsacugCfaCfCfAfuugcuguu cuL96 | 832 | asGfsaadCa(G2p)caauggUfgCfagu gasgsu | 1191 | ACUCACUGCACCAUUGCUGUU CC | 1550 |
| AD-1136071.1 | csascugcAfcCfAfUfugcuguuc cuL96 | 833 | asGfsgadAc(Agn)gcaaugGfuGfcag ugsasg | 1192 | CUCACUGCACCAUUGCUGUUC CA | 1551 |
| AD-1136072.1 | cscsauugCfuGfUfUfccaaaagg cuL96 | 834 | asGfsccuUfuuggaacAfgCfaauggsus g | 1193 | CACCAUUGCUGUUCCAAAAGG CG | 1552 |
| AD-1136073.1 | asgscucuUfuGfUfGfucuacaca guL96 | 835 | asCfsugdTg(Tgn)agacacAfaAfgagc uscsc | 1194 | GGAGCUCUUUGUGUCUACACA GA | 1553 |
| AD-1136074.1 | gscsucuuUfgUfGfUfcuacacag auL96 | 836 | asUfscudGu(G2p)uagacaCfaAfaga gcsusc | 1195 | GAGCUCUUUGUGUCUACACAG AA | 1554 |
| AD-1136075.1 | csuscuuuGfuGfUfCfuacacaga auL96 | 837 | asUfsucdTg(Tgn)guagacAfcAfaaga gscsu | 1196 | AGCUCUUUGUGUCUACACAGA AC | 1555 |
| AD-1136076.1 | uscsuuugUfgUfCfUfacacagaa cuL96 | 838 | asGfsuudCu(G2p)uguagaCfaCfaaa gasgsc | 1197 | GCUCUUUGUGUCUACACAGAA CA | 1556 |
| AD-1136077.1 | csusuugUfgUfCfUfAfcacagaac auL96 | 839 | asUfsgudTc(Tgn)guguagAfcAfcaaa gsasg | 1198 | CUCUUUGUGUCUACACAGAAC AC | 1557 |
| AD-1136078.1 | ususugugUfcUfUfAfCfacagaaca cuL96 | 840 | asGfsugdTu(C2p)uguaGfaCfaca aasgsa | 1199 | UCUUUGUGUCUACACAGAACA CC | 1558 |
| AD-1136079.1 | ascsacagAfaCfAfCfcaugaaga cuL96 | 841 | asGfsucdTu(C2p)augguGfuUfcugu gusasg | 1200 | CUACACAGAACACCAUGAAGA CC | 1559 |
| AD-1136080.1 | gsasgcuuUfgUfUfGfcaaaaaug uuL96 | 842 | asAfscauUfuuugcaaCfaAfagcucsusg | 1201 | CAGAGCUUUGUUGCAAAAAU GUU | 1560 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136081.1 | asgscuuuGfuUfGfCfaaaaaugu uuL96 | 843 | asAfsacaUfuuuugcaAfcAfaagcuscsu | 1202 | AGAGCUUUGUUGCAAAAAUG UUG | 1561 |
| AD-1136082.1 | asgsgaucUfcUfCfUfcagaguau uuL96 | 844 | asAfsaudAc(Tgn)cugagaGfaGfaucc usgsg | 1203 | CCAGGAUCUCUCAGAGUAUUA | 1562 |
| AD-1136083.1 | gsgsaucuCfuCfUfCfagaguauu auL96 | 845 | asUfsaadTa(C2p)ucugagAfgAfgau ccsusg | 1204 | CAGGAUCUCUCAGAGUAUU AU | 1563 |
| AD-1136084.1 | gsasucucUfcUfCfAfgaguauua uuL96 | 846 | asAfsuaaUfacucugaGfaGfagaucscsu | 1205 | AGGAUCUCUCAGAGUAUUA UG | 1564 |
| AD-1136085.1 | asuscucuCfuCfCfAfGfaguauuau guL96 | 847 | asCfsauaAfuacucugAfgAfgagauscsc | 1206 | GGAUCUCUCAGAGUAUUAU GG | 1565 |
| AD-1136086.1 | uscsucucUfcAfGfAfguauuau gguL96 | 848 | asCfscauAfauacucuGfaGfagagasusc | 1207 | GAUCUCUCAGAGUAUUAUG GA | 1566 |
| AD-1136087.1 | csuscucuCfaGfAfGfuauuaugg auL96 | 849 | asUfsccaUfaauacucUfgAfgagagsasu | 1208 | AUCUCUCAGAGUAUUAUGG AA | 1567 |
| AD-1136088.1 | uscsucucAfgAfGfUfauuaugg aauL96 | 850 | asUfsuccAfuaauacuCfuGfagagasgsa | 1209 | UCUCUCAGAGUAUUAUGGA AC | 1568 |
| AD-1136089.1 | csuscucaGfaGfUfAfuuauggaa cuL96 | 851 | asGfsuudCc(Agn)uaauacUfcUfgag agsasg | 1210 | CUCUCUCAGAGUAUUAUGGAA CG | 1569 |
| AD-1136090.1 | uscsucagAfgUfAfUfuauggaac guL96 | 852 | asCfsguuCfcauaauaCfuCfugagasgsa | 1211 | UCUCUCAGAGUAUUAUGGAAC GA | 1570 |
| AD-1136091.1 | uscsagagUfaUfUfAfuggaacga guL96 | 853 | asCfsucgUfuccauaaUfaCfucugasgsa | 1212 | UCUCAGAGUAUUAUGGAACG AGC | 1571 |
| AD-1136092.1 | csasgaguAfuUfAfUfUfggaacgag cuL96 | 854 | asGfscucGfuuccauaAfuAfcucugsasg | 1213 | CUCAGAGUAUUAUGGAACGA GCU | 1572 |
| AD-1136093.1 | gscsgugCfaAfAfAfccaaccuu cuL96 | 855 | asGfsaadGg(Tgn)ugguuuUfgCfaca gcscsg | 1214 | CGGCUGUGCAAAACCAACCUU CC | 1573 |
| AD-1136094.1 | csusugcAfaAfAfCfcaaccuuc cuL96 | 856 | asGfsgadAg(G2p)uugguuUfuGfcac agscsc | 1215 | GGCUGUGCAAAACCAACCUUC CC | 1574 |
| AD-1136095.1 | cscsugaAfcAfCfUfucaaccag auL96 | 857 | asUfscudGg(Tgn)ugaaguGfuGfuca ggsusc | 1216 | GACCUGACACACUUCAACCAG AA | 1575 |
| AD-1136096.1 | usgsacacAfcUfUfCfaaccagaa guL96 | 858 | asCfsuudCu(G2p)guugaaGfuGfugu casgsg | 1217 | CCUGACACACUUCAACCAGAA GC | 1576 |
| AD-1136097.1 | gsascacaCfuUfCfAfaccagaag cuL96 | 859 | asGfscudTc(Tgn)gguugaAfgUfgug ucsasg | 1218 | CUGACACACUUCAACCAGAAG CU | 1577 |
| AD-1136098.1 | ascsacuuCfaAfCfCfagaagcuu guL96 | 860 | asCfsaagCfuucugguUfgAfagugusgsu | 1219 | ACACACUUCAACCAGAAGCUU GA | 1578 |
| AD-1136099.1 | asusgccuAfgCfAfAfgcucucag uuL96 | 861 | asAfscudGa(G2p)agcuugCfuAfggc aususc | 1220 | GAAUGCCUAGCAAGCUCUCAG UA | 1579 |
| AD-1136100.1 | cscsuagcAfaGfCfUfcucaguau cuL96 | 862 | asGfsaudAc(Tgn)gagagcUfuGfcua ggscsa | 1221 | UGCCUAGCAAGCUCUCAGUAU CA | 1580 |
| AD-1136101.1 | csusagcaAfgCfUfCfucaguauc auL96 | 863 | asUfsgadTa(C2p)ugagagCfuUfgcu agsgsc | 1222 | GCCUAGCAAGCUCUCAGUAUC AU | 1581 |
| AD-1136102.1 | usascaaGfcUfCfUfcaguauca uuL96 | 864 | asAfsugaUfacugagaGfcUfugcuasgsg | 1223 | CCUAGCAAGCUCUCAGUAUCA UG | 1582 |
| AD-1136103.1 | asgscaagCfuCfUfCfcaguaucau guL96 | 865 | asCfsaugAfuacugagAfgCfuugcusasg | 1224 | CUAGCAAGCUCUCAGUAUCAU GC | 1583 |
| AD-1136104.1 | csasagcuCfuCfAfGfuaucaugc uuL96 | 866 | asAfsgcdAu(G2p)auacugAfgAfgcu ugscsu | 1225 | AGCAAGCUCUCAGUAUCAUGC UC | 1584 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136105.1 | csuscggaAfgAfGfUfgagguugacuL96 | 867 | asGfsucdAa(C2p)cucacuCfuUfccgagscsa | 1226 | UGCUCGGAAGAGUGAGGUUGACA | 1585 |
| AD-1136106.1 | asasggagAfaUfUfGfuuggaaaaauL96 | 868 | asUfsuudTu(C2p)caacaaUfuCfuccuusgsu | 1227 | ACAAGGAGAAUUGUUGGAAAAAG | 1586 |
| AD-1136107.1 | csasccaaGfuUfUfGfgaauaagcuuL96 | 869 | asAfsgcuUfauuccaaAfcUfggugsgsg | 1228 | CCCACCAAGUUUGGAAUAAGCUU | 1587 |
| AD-1136108.1 | ascscaagUfuUfGfGfaauaagcuuuL96 | 870 | asAfsagcUfauuccaAfaCfuuggusgsg | 1229 | CCACCAAGUUUGGAAUAAGCUUU | 1588 |
| AD-1136109.1 | asgsuuccUfuUfUfCfugaaucagguL96 | 871 | asCfscugAfuucagaaAfaGfgaacusgsu | 1230 | ACAGUUCCUUUUCUGAAUCAGGC | 1589 |
| AD-1136110.1 | gsusuccUfuUfCfUfgaaucaggcuL96 | 872 | asGfsccdTg(Agn)uucagaAfaAfggaacsusg | 1231 | CAGUUCCUUUUCUGAAUCAGGCA | 1590 |
| AD-1136111.1 | ususcccuuUfuCfUfGfaaucaggcauL96 | 873 | asUfsgcdCu(G2p)auucagAfaAfaggaascsu | 1232 | AGUUCCUUUUCUGAAUCAGGCAG | 1591 |
| AD-1136112.1 | usascuucAfuGfUfGfuacacagauuL96 | 874 | asAfsucdTg(Tgn)guacacAfuGfaaguasgsg | 1233 | CCUACUUCAUGUGUACACAGAUG | 1592 |
| AD-1136114.1 | csasaggcCfuUfCfAfuaccaaaauuL96 | 875 | asAfsuudTu(G2p)guaugaAfgGfccuugsgsc | 1234 | GCCAAGGCCUUCAUACCAAAAUG | 1593 |
| AD-1136115.1 | asasggccUfuCfAfUfaccaaaauguL96 | 876 | asCfsauuUfugguaugAfaGfgccuusgsg | 1235 | CCAAGGCCUUCAUACCAAAAUGG | 1594 |
| AD-1136116.1 | gscscuucAfuAfCfCfaaaaugguccL96 | 877 | asGfsaccAfuuuugguAfuGfaaggcscsu | 1236 | AGGCCUUCAUACCAAAAUGGUCC | 1595 |
| AD-1136117.1 | csasccucUfaAfGfAfuuuauaucauL96 | 878 | asUfsgauAfuaaaucuUfaGfaggugsgsg | 1237 | CCCACCUCUAAGAUUUAUAUCAG | 1596 |
| AD-1136118.1 | ascscucuAfaGfAfUfuuauaucaguL96 | 879 | asCfsugaUfauaaaucUfuAfgaggusgsg | 1238 | CCACCUCUAAGAUUUAUAUCAGC | 1597 |
| AD-1136119.1 | gscsgagaCfaAfGfCfacuaacacuuL96 | 880 | asAfsgudGu(Tgn)agugcuUfgUfcucgcsusg | 1239 | CAGCGAGACAAGCACUAACACUG | 1598 |
| AD-1136120.1 | csgsagacAfaGfCfAfcuaacacuguL96 | 881 | asCfsagdTg(Tgn)uagugcCfuUfGfucucgscsu | 1240 | AGCGAGACAAGCACUAACACUGU | 1599 |
| AD-1136121.1 | gsasgacaAfgCfAfCfuaacacuguuL96 | 882 | asAfscadGu(G2p)uuagugCfuUfgucucsgsc | 1241 | GCGAGACAAGCACUAACACUGUG | 1600 |
| AD-1136122.1 | asgsacaaGfcAfCfUfaacacuguguL96 | 883 | asCfsacdAg(Tgn)guuaguGfcUfugucuscsg | 1242 | CGAGACAAGCACUAACACUGUGC | 1601 |
| AD-1136123.1 | csgsgcuuGfuCfAfGfaccaucuuguL96 | 884 | asCfsaagAfuggucugAfcAfagccgscsa | 1243 | UGCGGCUUGUCAGACCAUCUUGA | 1602 |
| AD-1136124.1 | gsgsgcuugUfcAfGfAfccaucuugauL96 | 885 | asUfscaaGfauggucuGfaCfaagccsgsc | 1244 | GCGGCUUGUCAGACCAUCUUGAA | 1603 |
| AD-1136125.1 | gscsuuguCfaGfAfCfcaucuugauL96 | 886 | asUfsucdAa(G2p)auggucUfgAfcaagcscsg | 1245 | CGGCUUGUCAGACCAUCUUGAAA | 1604 |
| AD-1136126.1 | csusuguCfAfgAfCfCfaucuugaauL96 | 887 | asUfsuudCa(Agn)gauggCfuUfGfacaagscsc | 1246 | GGCUUGUCAGACCAUCUUGAAAA | 1605 |
| AD-1136127.1 | ususugucaGfaCfCfAfucuugaaaauL96 | 888 | asUfsuudTc(Agn)agauggUfcCfugacaasgsc | 1247 | GCUUGUCAGACCAUCUUGAAAAG | 1606 |
| AD-1136128.1 | usgsucagAfcCfAfUfcuugaaaguL96 | 889 | asCfsuuuUfcaagaugGfuCfugacascsas | 1248 | CUUGUCAGACCAUCUUGAAAAGG | 1607 |
| AD-1136129.1 | gsuscagaCfcAfUfCfuugaaaagguL96 | 890 | asCfscuuUfucaagauGfgUfcugacsasa | 1249 | UUGUCAGACCAUCUUGAAAAGGC | 1608 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136130.1 | uscsagacCfaUfCfUfugaaaaggcuL96 | 891 | asGfsccuUfuucaagaUfgGfucugascsa | 1250 | UGUCAGACCAUCUUGAAAAGGCU | 1609 |
| AD-1136131.1 | ascsccuaCfaAfGfAfagaagaaucuL96 | 892 | asGfsaudTc(Tgn)ucuucuUfgUfagggususc | 1251 | GAACCCUACAAGAAGAAGAAUCC | 1610 |
| AD-1136132.1 | csusgccaCfuGfGfGfuuuuauagauL96 | 893 | asUfscuaUfaaaacccAfgUfggcagsasc | 1252 | GUCUGCCACUGGGUUUUAUAGAA | 1611 |
| AD-1136133.1 | usgccacUfgGfGfUfuuuauagaauL96 | 894 | asUfsucuAfuaaaaccCfaGfuggcasgsa | 1253 | UCUGCCACUGGGUUUUAUAGAAC | 1612 |
| AD-1136134.1 | csascuggGfuUfUfUfauagaacacuL96 | 895 | asGfsugdTu(C2p)uauaaaAfcCfcagugsgsc | 1254 | GCCACUGGGUUUUAUAGAACACC | 1613 |
| AD-1136135.1 | ascsugggUfuUfUfAfuagaacaccuL96 | 896 | asGfsgudGu(Tgn)cuauaaAfaCfccagusgsg | 1255 | CCACUGGGUUUUAUAGAACACCC | 1614 |
| AD-1136136.1 | gsgsguuuUfaUfAfGfaacacccaauL96 | 897 | asUfsugdDg(Tgn)guucuaUfaAfaacccsasg | 1256 | CUGGGUUUUAUAGAACACCCAAU | 1615 |
| AD-1136137.1 | gsgsuuuuAfuAfGfAfacacccaauuL96 | 898 | asAfsuudGg(G2p)uguucaAfuUfaaaccscsa | 1257 | UGGGUUUUAUAGAACACCCAAUC | 1616 |
| AD-1136138.1 | usgsgggcuAfcAfGfCfuuugagacuuL96 | 899 | asAfsgudCu(C2p)aaagcUfuAfgccasgsa | 1258 | UCUGGGCUACAGCUUUGAGACUA | 1617 |
| AD-1136139. | gsgsgcuaCfaGfCfUfuugagacuauL96 | 900 | asUfsagdTc(Tgn)caaagcUfgUfagcccsasg | 1259 | CUGGGCUACAGCUUUGAGACUAA | 1618 |
| AD-1136140.1 | gscsuacaGfcUfUfUfgagacuaacuL96 | 901 | asGfsuudAg(Tgn)cucaaaGfcUfguagcscsc | 1260 | GGGCUACAGCUUUGAGACUAACU | 1619 |
| AD-1136141.1 | csusacagCfuUfUfGfagacuaacuuL96 | 902 | asAfsgudTa(G2p)ucucaaAfgCfuguagscsc | 1261 | GGCUACAGCUUUGAGACUAACUC | 1620 |
| AD-1136142.1 | usascagcUfuUfGfAfgacuaacucuL96 | 903 | asGfsagdTu(Agn)gucucaAfaGfcuguasgsc | 1262 | GCUACAGCUUUGAGACUAACUCA | 1621 |
| AD-1136143.1 | ascsagcuUfuGfAfGfacuaacucauL96 | 904 | asUfsgadGu(Tgn)agucucAfaAfgcugusasg | 1263 | CUACAGCUUUGAGACUAACUCAG | 1622 |
| AD-1136144.1 | csasgcuuUfgAfGfAfcuaacucaguL96 | 905 | asCfsugaGfuuagucuCfaAfagcugsusa | 1264 | UACAGCUUUGAGACUAACUCAGG | 1623 |
| AD-1136145.1 | asgscuuuGfaGfAfCfuaacucagguL96 | 906 | asCfscudGa(G2p)uuagucUfcAfaagcusgsu | 1265 | ACAGCUUUGAGACUAACUCAGGG | 1624 |
| AD-1136146.1 | csusuccaCfuAfCfUfucagcuauguL96 | 907 | asCfsaudAg(C2p)ugaaguAfgUfggaagsgsg | 1266 | CCCUUCCACUACUUCAGCUAUGG | 1625 |
| AD-1136147.1 | ususccacUfaCfUfUfcagcuauguL96 | 908 | asCfscauAfgcugaagUfaGfuggaasgsg | 1267 | CCUUCCACUACUUCAGCUAUGG | 1626 |
| AD-1136148.1 | gsusggcuUfgCfUfCfugaaguagauL96 | 909 | asUfscudAc(Tgn)ucagagCfaAfgccacscsc | 1268 | GGGUGGCUUGCUCUGAAGUAGAA | 1627 |
| AD-1136149.1 | usgsgcuuGfcUfCfUfgaaguagaauL96 | 910 | asUfsucdTa(C2p)uucagaGfcAfgccascscs | 1269 | GGUGGCUUGCUCUGAAGUAGAAA | 1628 |
| AD-1136150.1 | gsgscuugCfuCfUfGfaaguagaaauL96 | 911 | asUfsuudCu(Agn)cuucagAfgCfaagccsasc | 1270 | GUGGCUUGCUCUGAAGUAGAAAU | 1629 |
| AD-1136151.1 | gscsuugcUfcUfGfAfaguagaaauuL96 | 912 | asAfsuudTc(Tgn)acuucaGfaGfcaagcscsa | 1271 | UGGCUUGCUCUGAAGUAGAAAUC | 1630 |
| AD-1136152.1 | cscsuaacAfgGfAfGfaucauaagauL96 | 913 | asUfscuuAfugaucucCfuGfuuaggscsa | 1272 | UGCCUAACAGGAGAUCAUAAGAA | 1631 |
| AD-1136153.1 | csusaacaGfgAfGfAfucauaagaauL96 | 914 | asUfsucdTu(Agn)ugaucuCfcUfguuagsgsc | 1273 | GCCUAACAGGAGAUCAUAAGAAC | 1632 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136154.1 | usasacagGfaGfAfUfcauaagaacuL96 | 915 | asGfsuucUfuaugaucUfcCfuguuasgsg | 1274 | CCUAACAGGAGAUCAUAAGAACC | 1633 |
| AD-1136155.1 | asascaggAfgAfUfCfauaagaaccuL96 | 916 | asGfsgudTc(Tgn)uaugauCfuCfcguusasg | 1275 | CUAACAGGAGAUCAUAAGAACU | 1634 |
| AD-1136156.1 | cscsuccgCfaCfAfGfauauuguc auL96 | 917 | asUfsgacAfauaucugUfCfggaggsusu | 1276 | AACCUCCGCACAGAUAUUGUCAU | 1635 |
| AD-1136157.1 | csusccgcAfcAfGfAfuauuguca uuL96 | 918 | asAfsugaCfaauaucuGfuGfcggagsgsu | 1277 | ACCUCCGCACAGAUAUUGUCAUG | 1636 |
| AD-1136158.1 | ususggcuCfcAfGfUfcuaaaccc uuL96 | 919 | asAfsggdGu(Tgn)uagacuGfgAfgccaascsa | 1278 | UGUUGGCUCCAGUCUAAACCCUG | 1637 |
| AD-1136159.1 | ususccugGfcUfGfCfuucuaucu uuL96 | 920 | asAfsagaUfagaagcaGfcCfaggaasgsa | 1279 | UCUUCCUGGCUGCUUCUAUCUUC | 1638 |
| AD-1136160.1 | uscscuggCfuGfCfUfucuaucuu cuL96 | 921 | asGfsaagAfuagaagcAfgCfcaggasasg | 1280 | CUUCCUGGCUGCUUCUAUCUUCU | 1639 |
| AD-1136161.1 | cscsuggcUfgCfUfUfcuaucuuc uuL96 | 922 | asAfsgaaGfauagaagCfaGfccaggsasa | 1281 | UUCCUGGCUGCUUCUAUCUUCUU | 1640 |
| AD-1136162.1 | csusggcuGfcUfUfCfuaucuucu uuL96 | 923 | asAfsagaAfgauagaaGfcAfgccagsgsa | 1282 | UCCUGGCUGCUUCUAUCUUCUUU | 1641 |
| AD-1136163.1 | usgsgcugCfuUfCfUfaucuucu uuuL96 | 924 | asAfsaagAfagauagaAfgCfagccasgsg | 1283 | CCUGGCUGCUUCUAUCUUCUUUG | 1642 |
| AD-1136164.1 | gscsugcuUfcUfAfUfcuucuuu gcuL96 | 925 | asGfscaaAfgaagauaGfaAfgcagcscsa | 1284 | UGGCUGCUUCUAUCUUCUUUGCC | 1643 |
| AD-1136165.1 | csusgcuuCfuAfUfCfuucuuug ccuL96 | 926 | asGfsgcaAfagaagauAfgAfagcagscsc | 1285 | GGCUGCUUCUAUCUUCUUUGCCA | 1644 |
| AD-1136166.1 | usgscuucUfaUfCfUfucuuugcc auL96 | 927 | asUfsggdCa(Agn)agaagaUfaGfaagcasgsc | 1286 | GCUGCUUCUAUCUUCUUUGCCAU | 1645 |
| AD-1136167.1 | gscsuucuAfuCfUfUfcuuugcca uuL96 | 928 | asAfsugdGc(Agn)aagaagAfuAfgaagcsasg | 1287 | CUGCUUCUAUCUUCUUUGCCAUC | 1646 |
| AD-1136168.1 | csusucuaUfcUfUfCfuuugccau cuL96 | 929 | asGfsaudGg(C2p)aaagaaGfaUfagaagscsa | 1288 | UGCUUCUAUCUUCUUUGCCAUCA | 1647 |
| AD-1136169.1 | ususcuauCfuUfCfUfuugccauc auL96 | 930 | asUfsgadTg(G2p)caaagaAfgAfuagaasgsc | 1289 | GCUUCUAUCUUCUUUGCCAUCAA | 1648 |
| AD-1136170.1 | uscsuaucUfuCfUfUfugccauca auL96 | 931 | asUfsugdAu(G2p)gcaaagAfaGfauagasasg | 1290 | CUUCUAUCUUCUUUGCCAUCAAA | 1649 |
| AD-1136171.1 | csusaucuUfcUfUfUfgccaucaa auL96 | 932 | asUfsuudGa(Tgn)ggcaaaGfaAfgauagsasa | 1291 | UUCUAUCUUCUUUGCCAUCAAAG | 1650 |
| AD-1136172.1 | usasucuuCfuUfUfGfccaucaaa guL96 | 933 | asCfsuuuGfauggcaaAfgAfagauasgsa | 1292 | UCUAUCUUCUUUGCCAUCAAAGA | 1651 |
| AD-1136173.1 | asusucuuCfuUfUfGfCfcaucaaag auL96 | 934 | asUfscudTu(G2p)auggcaAfaGfaagausasg | 1293 | CUAUCUUCUUUGCCAUCAAAGAU | 1652 |
| AD-1136174.1 | csusucuuUfgCfCfAfucaaagau guL96 | 935 | asCfsaucUfuugauggCfaAfagaagsasu | 1294 | AUCUUCUUUGCCAUCAAAGAUGC | 1653 |
| AD-1136175.1 | gsasgcucAfgCfAfCfacagguaa uuL96 | 936 | asAfsuudAc(C2p)uguguCfuGfagcucsgsa | 1295 | UCGAGCUCAGCACACAGGUAAUA | 1654 |
| AD-1136176.1 | csuscagcAfcAfCfAfgguaauaa cuL96 | 937 | asGfsuuaUfuaccuguGfuGfcugagscsu | 1296 | AGCUCAGCACACAGGUAAUAACG | 1655 |
| AD-1136177.1 | uscsagcaCfaCfAfGfguaauaac guL96 | 938 | asCfsguuAfuuaccugUfgUfgcugasgsc | 1297 | GCUCAGCACACAGGUAAUAACGU | 1656 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136178.1 | csasgcacAfcAfGfGfuaauaacguuL96 | 939 | asAfscguUfauuaccuGfuGfugcugsasg | 1298 | CUCAGCACACAGGUAAUAACGUG | 1657 |
| AD-1136179.1 | ascsagguAfaUfAfAfcgugaaggauL96 | 940 | asUfsccdTu(C2p)acguuaUfuAfccugusgsu | 1299 | ACACAGGUAAUAACGUGAAGGAA | 1658 |
| AD-1136180.1 | csasgguaAfuAfAfCfgugaaggauL96 | 941 | asUfsucdCu(Tgn)cacguuAfuUfaccugsusg | 1300 | CACAGGUAAUAACGUGAAGGAAC | 1659 |
| AD-1136181.1 | asgsguaaUfaAfCfGfugaaggaacuL96 | 942 | asGfsuudCc(Tgn)ucacguUfaUfuaccusgsu | 1301 | ACAGGUAAUAACGUGAAGGAACU | 1660 |
| AD-1136182.1 | asusaacgUfgAfAfGfgaacucuucuL96 | 943 | asGfsaadGa(G2p)uuccuuCfaCfguuaususa | 1302 | UAAUAACGUGAAGGAACUCUUCC | 1661 |
| AD-1136183.1 | usasacguGfaAfGfGfaacucuuccuL96 | 944 | asGfsgadAg(Agn)guuccuUfcAfcguuasusu | 1303 | AAUAACGUGAAGGAACUCUUCCG | 1662 |
| AD-1136184.1 | cscscagaAfaAfCfUfgcaaacccuuL96 | 945 | asAfsggdGu(Tgn)ugcaguUfuUfcugggsasc | 1304 | GUCCCAGAAAACUGCAAACCCUG | 1663 |
| AD-1136185.1 | csascagaAfcAfUfGfgaucuauuauL96 | 946 | asUfsaadTa(G2p)auccauGfuUfcugugsgsu | 1305 | ACCACAGAACAUGGAUCUAUUAA | 1664 |
| AD-1136186.1 | ascsagaaCfaUfGfGfaucuauuauL96 | 947 | asUfsuaaUfagauccaUfgUfucugusgsg | 1306 | CCACAGAACAUGGAUCUAUUAAA | 1665 |
| AD-1136187.1 | csasgaacAfuGfGfAfucuauuaauL96 | 948 | asUfsuuaAfuagauccAfuGfuucugsusg | 1307 | CACAGAACAUGGAUCUAUUAAAG | 1666 |
| AD-1136188.1 | asgsaacaUfgGfAfUfcuauuaaaguL96 | 949 | asCfsuuuAfauagaucCfaUfguucusgsu | 1308 | ACAGAACAUGGAUCUAUUAAAGU | 1667 |
| AD-1136189.1 | gsasacauGfgAfUfCfuauuaaaguuL96 | 950 | asAfscuuUfaauagauCfcAfuguucsusg | 1309 | CAGAACAUGGAUCUAUUAAAGUC | 1668 |
| AD-1136190.1 | asascaugGfaUfCfUfauuaaaagucL96 | 951 | asGfsacuUfaauagaUfcCfauguuscsu | 1310 | AGAACAUGGAUCUAUUAAAGUCA | 1669 |
| AD-1136191.1 | ascsauggAfuCfUfAfuuaaaagucauL96 | 952 | asUfsgadCu(Tgn)uaauagAfuCfcaugususc | 1311 | GAACAUGGAUCUAUUAAAGUCAC | 1670 |
| AD-1136192.1 | csasuggaUfcUfAfUfuaaagucacuL96 | 953 | asGfsugdAc(Tgn)uuaauaGfaUfccaugsusu | 1312 | AACAUGGAUCUAUUAAAGUCACA | 1671 |
| AD-1136193.1 | asusggauCfuAfUfUfaaagucacauL96 | 954 | asUfsgudGa(C2p)uuuaauAfgAfuccausgsu | 1313 | ACAUGGAUCUAUUAAAGUCACAG | 1672 |
| AD-1136194.1 | usgsgaucUfaUfUfAfaagucacaguL96 | 955 | asCfsugdTg(Agn)cuuuaaUfaGfauccasusg | 1314 | CAUGGAUCUAUUAAAGUCACAGA | 1673 |
| AD-1136195.1 | gsgsaucuAfuUfAfAfagucacaguL96 | 956 | asUfscudGu(G2p)acuuuaAfuAfgauccsasu | 1315 | AUGGAUCUAUUAAAGUCACAGAA | 1674 |
| AD-1136196.1 | gsasucuaUfuAfAfAfgucacagaauL96 | 957 | asUfsucdTg(Tgn)gacuuuAfaUfagaucscsa | 1316 | UGGAUCUAUUAAAGUCACAGAAU | 1675 |
| AD-1136197.1 | ascsaaugAfuAfAfGfcaaauucauL96 | 958 | asUfsugaAfuuugcuuAfuCfaugugssu | 1317 | ACACAAUGAUAAGCAAAUUCAAA | 1676 |
| AD-1136198.1 | csasaugaUfaAfGfCfaaauucaauL96 | 959 | asUfsuudGa(Agn)uuugcuAfuCfaugusg | 1318 | CACAAUGAUAAGCAAAUUCAAAA | 1677 |
| AD-1136199.1 | asusgauaAfgCfAfAfauucaaaauL96 | 960 | asGfsuudTu(G2p)aauuugCfuUfaucaususg | 1319 | CAAUGAUAAGCAAAUUCAAAACU | 1678 |
| AD-1136200.1 | asusgccuAfaAfUfGfgugaauauuL96 | 961 | asCfsauaUfucaccauUfuAfggcausasa | 1320 | UUUAUGCCUAAAUGGUGAAUAUGC | 1679 |
| AD-1136201.1 | usgsccuaAfaUfGfGfugaauauguL96 | 962 | asGfscauAfuucaccaUfuUfaggcasusa | 1321 | UAUGCCUAAAUGGUGAAUAUGCA | 1680 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136202.1 | gscscuaaAfuGfGfUfgaauaugc auL96 | 963 | asUfsgcdAu(Agn)uucaccAfuUfuag gcsasu | 1322 | AUGCCUAAAUGGUGAAUAUG CAA | 1681 |
| AD-1136203.1 | cscsuaaaUfgGfUfGfaauaugca auL96 | 964 | asUfsugdCa(Tgn)auucacCfaUfuuag gscsa | 1323 | UGCCUAAAUGGUGAAUAUGC AAU | 1682 |
| AD-1136204.1 | csusaaauGfgUfGfAfauaugcaa uuL96 | 965 | asAfsuudGc(Agn)uauucaCfcAfuuu agsgsc | 1324 | GCCUAAAUGGUGAAUAUGCA AUU | 1683 |
| AD-1136205.1 | asasugguGfaAfUfAfugcaauua guL96 | 966 | asCfsuaaUfugcauauUfcAfccauusus a | 1325 | UAAAUGGUGAAUAUGCAAUU AGG | 1684 |
| AD-1136206.1 | csgsggaaGfgGfUfUfugugcua uuuL96 | 967 | asAfsaudAg(C2p)acaaacCfcUfuccc gsasc | 1326 | GUCGGGAAGGGUUUGUGCUA UUC | 1685 |
| AD-1136207.1 | gsgsgaaGfgUfUfUfgugcuau ucuL96 | 968 | asGfsaadTa(G2p)cacaaaCfcCfuucc csgsa | 1327 | UCGGGAAGGGUUUGUGCUAU UCC | 1686 |
| AD-1136208.1 | gsgsaaggGfuUfUfGfugcuauu ccuL96 | 969 | asGfsgaaUfagcacaaAfcCfcuuccscs g | 1328 | CGGGAAGGGUUUGUGCUAUU CCC | 1687 |
| AD-1136209.1 | gsusauaaCfcUfCfAfaguucuga uuL96 | 970 | asAfsucaGfaacuugaGfgUfuauacsas g | 1329 | CUGUAUAACCUCAAGUUCUGA UG | 1688 |
| AD-1136210.1 | usasuaaCfcUfCfAfAfguucugau guL96 | 971 | asCfsaudCa(G2p)aacuugAfgGfuua uascsa | 1330 | UGUAUAACCUCAAGUUCUGAU GG | 1689 |
| AD-1136211.1 | cscsucaaGfuUfCfUfgauggugu cuL96 | 972 | asGfsacdAc(C2p)aucagaAfcUfuga ggsusu | 1331 | AACCUCAAGUUCUGAUGGUGU CU | 1690 |
| AD-1136212.1 | csasaguuCfuGfAfUfgguguct guuL96 | 973 | asAfscadGa(C2p)accaucAfgAfacuu gsasg | 1332 | CUCAAGUUCUGAUGGUGUCUG UC | 1691 |
| AD-1136213.1 | cscsacaaAfcCfUfCfuagaagcu uuL96 | 974 | asAfsagdCu(Tgn)cuagagGfuUfugu ggsgsa | 1333 | UCCCACAAACCUCUAGAAGCU UA | 1692 |
| AD-1136214.1 | ascsaaacCfuCfUfAfgaagcuua auL96 | 975 | asUfsuadAg(C2p)uucuagAfgGfuuu gusgsg | 1334 | CCACAAACCUCUAGAAGCUUA AA | 1693 |
| AD-1136215.1 | asasaccuCfuAfGfAfagcuuaaa cuL96 | 976 | asGfsuuuAfagcuucuAfgAfgguuusg su | 1335 | ACAAACCUCUAGAAGCUUAAA CC | 1694 |
| AD-1136216.1 | asasccucUfaGfAfAfgcuuaaac cuL96 | 977 | asGfsguuUfaagcuucUfaGfagguusus g | 1336 | CAAACCUCUAGAAGCUUAAAC CG | 1695 |
| AD-1136217.1 | usgsgccuUfcAfAfAfccaaugaa cuL96 | 978 | asGfsuucAfuugguuuGfaAfggccasg sg | 1337 | CCUGGCCUUCAAACCAAUGAA CA | 1696 |
| AD-1136218.1 | gsgsccuuCfaAfAfCfcaaugaac auL96 | 979 | asUfsgudTc(Agn)uugguuUfgAfagg ccsasg | 1338 | CUGGCCUUCAAACCAAUGAAC AG | 1697 |
| AD-1136219.1 | gscscuucAfaAfCfCfaaugaaca guL96 | 980 | asCfsuguUfcauugguUfuGfaaggcscs a | 1339 | UGGCCUUCAAACCAAUGAACA GC | 1698 |
| AD-1136220.1 | uscsaaacCfaAfUfGfaacagcaa auL96 | 981 | asUfsuudGc(Tgn)guucauUfgGfuuu gasasg | 1340 | CUUCAAACCAAUGAACAGCAA AG | 1699 |
| AD-1136221.1 | gsasacagCfaAfAfGfcauaaccu uuL96 | 982 | asAfsaggUfaugcuuUfgCfuguucsas u | 1341 | AUGAACAGCAAAGCAUAACCU UG | 1700 |
| AD-1136222.1 | asasacagcAfaAfGfCfauaaccuu guL96 | 983 | asCfsaadGg(Tgn)uaugcuUfuGfcug uuscsa | 1342 | UGAACAGCAAAGCAUAACCUU GA | 1701 |
| AD-1136223.1 | asgscaaaGfcAfUfAfaccuugaa uuL96 | 984 | asAfsuucAfagguuauGfcUfuugcusg su | 1343 | ACAGCAAAGCAUAACCUUGAA UC | 1702 |
| AD-1136224.1 | gscsaaagCfaUfAfAfccuugaau cuL96 | 985 | asGfsaudTc(Agn)agguuaUfgCfuuu gcsusg | 1344 | CAGCAAAGCAUAACCUUGAAU CU | 1703 |
| AD-1136225.1 | csasaagcAfuAfAfCfcuugaauc uuL96 | 986 | asAfsgadTu(C2p)aagguAfuGfcuu ugscsu | 1345 | AGCAAAGCAUAACCUUGAAUC UA | 1704 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136226.1 | gscsauaaCfcUfUfGfaaucuauacuL96 | 987 | asGfsuauAfgauucaaGfgUfuaugcsusu | 1346 | AAGCAUAACCUUGAAUCUAUACU | 1705 |
| AD-1136227.1 | csasuaaCfuUfGfAfaucuauacuuL96 | 988 | asAfsguaUfagauucaAfgGfuuaugscsu | 1347 | AGCAUAACCUUGAAUCUAUACUC | 1706 |
| AD-1136228.1 | asusaaccUfuGfAfAfucuauacucuL96 | 989 | asGfsaguAfuagauucAfaGfguuausgsc | 1348 | GCAUAACCUUGAAUCUAUACUCA | 1707 |
| AD-1136229.1 | usasaccuUfgAfAfUfcuauacucauL96 | 990 | asUfsgadGu(Agn)uagauuCfaAfgguuasusg | 1349 | CAUAACCUUGAAUCUAUACUCAA | 1708 |
| AD-1136230.1 | asasccuuGfaAfUfCfuauacucauL96 | 991 | asUfsugdAg(Tgn)auagauUfcAfagguusasu | 1350 | AUAACCUUGAAUCUAUACUCAA | 1709 |
| AD-1136231.1 | ascscuugAfaUfCfUfauacucaauL96 | 992 | asUfsuudGa(G2p)uauagaUfuCfaagusguss | 1351 | UAACCUUGAAUCUAUACUCAAAU | 1710 |
| AD-1136232.1 | cscsuugaAfuCfUfAfuacucaaauuL96 | 993 | asAfsuudTg(Agn)guauagAfuUfcaaggsusu | 1352 | AACCUUGAAUCUAUACUCAAAUU | 1711 |
| AD-1136233.1 | asasucuaUfaCfUfCfaaauuuugcuL96 | 994 | asGfscaaAfauuugagUfaUfagauuscsa | 1353 | UGAAUCUAUACUCAAAUUUUGCA | 1712 |
| AD-1136234.1 | asuscuauAfcUfCfAfaaauuuugcauL96 | 995 | asUfsgcaAfaauuugaGfuAfuagaususc | 1354 | GAAUCUAUACUCAAAUUUUGCAA | 1713 |
| AD-1136235.1 | gsgsuuaaAfuCfCfUfcuaaccaucuL96 | 996 | asGfsaudGg(Tgn)uagaggAfuUfuaaccsusu | 1355 | AAGGUUAAAUCCUCUAACCAUCU | 1714 |
| AD-1136236.1 | usasaaucCfuCfUfAfaccaucuuuL96 | 997 | asAfsaadGa(Tgn)gguuagAfgGfauuuasasc | 1356 | GUUAAAUCCUCUAACCAUCUUUG | 1715 |
| AD-1136237.1 | asasauccUfcUfAfAfccaucuuuguL96 | 998 | asCfsaaaGfauggUfaGfgauuusasa | 1357 | UUAAAUCCUCUAACCAUCUUUGA | 1716 |
| AD-1136238.1 | asasuccuUfcAfAfCfcaucuuugauL96 | 999 | asUfscaaAfgauggUfuAfGfggauusa | 1358 | UAAAUCCUCUAACCAUCUUUGAA | 1717 |
| AD-1136239.1 | asusccucUfaAfCfCfaucuuugauL96 | 1000 | asUfsucaAfagauggUfaAfaggausussu | 1359 | AAAUCCUCUAACCAUCUUUGAAU | 1718 |
| AD-1136240.1 | uscscucuAfaCfCfAfucuuuugaauuL96 | 1001 | asAfsuucAfaagauggUfuAfgaggasussu | 1360 | AAUCCUCUAACCAUCUUUGAAUC | 1719 |
| AD-1136241.1 | cscsucuaAfcCfAfUfcuuugaaucuL96 | 1002 | asGfsaudTc(Agn)aagaugCfuUfagaggsasu | 1361 | AUCCUCUAACCAUCUUUGAAUCA | 1720 |
| AD-1136242.1 | csuscuaaCfcAfUfCfuuugaaucauL96 | 1003 | asUfsgadTu(C2p)aaagauGfgUfuagaasgsa | 1362 | UCCUCUAACCAUCUUUGAAUCAU | 1721 |
| AD-1136243.1 | uscsuaacCfaUfCfUfuugaaucauuL96 | 1004 | asAfsugaUfucaaagaUfgGfuuagasgsg | 1363 | CCUCUAACCAUCUUUGAAUCAUU | 1722 |
| AD-1136244.1 | csusaaccAfuCfUfUfugaaucauuuL96 | 1005 | asAfsudGa(Tgn)ucaaagAfuGfgttuagsasg | 1364 | CUCUAACCAUCUUUGAAUCAUUG | 1723 |
| AD-1136245.1 | usasaccaUfcUfUfUfgaaucauuguL96 | 1006 | asCfsadTg(Agn)uucaaaGfaUfgguuasgsa | 1365 | UCUAACCAUCUUUGAAUCAUUGG | 1724 |
| AD-1136246.1 | asasccauCfuUfUfGfaaucauuguL96 | 1007 | asCfscaaUfgauucaAfgAfugguusasg | 1366 | CUAACCAUCUUUGAAUCAUUGGA | 1725 |
| AD-1136247.1 | cscsaucuUfuGfAfAfucauuggauL96 | 1008 | asUfsuccAfaugauucAfaAfgauggsusu | 1367 | AACCAUCUUUGAAUCAUUGGAA | 1726 |
| AD-1136248.1 | csasucuuUfgAfAfUfcauuggaauL96 | 1009 | asUfsuudCc(Agn)augauuCfaAfagausgsu | 1368 | ACCAUCUUUGAAUCAUUGGAAG | 1727 |
| AD-1136249.1 | asuscuuuGfaAfUfCfauuggaaauL96 | 1010 | asCfsuudTc(C2p)aaugauCfaAfaagausgsg | 1369 | CCAUCUUUGAAUCAUUGGAAAGA | 1728 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136250.1 | csusuugaAfuCfAfUfuggaaagaauL96 | 1011 | asUfsucdTu(Tgn)ccaaugAfuUfcaaagsasu | 1370 | AUCUUUGAAUCAUUGGAAAGAAU | 1729 |
| AD-1136251.1 | gsasaagaAfuAfAfAfgaaugaaacuL96 | 1012 | asGfsuudTc(Agn)uucuuuAfuUfcuuucscsa | 1371 | UGGAAAGAAUAAAGAAUGAAACA | 1730 |
| AD-1136252.1 | asasagaaUfaAfAfGfaaugaaacauL96 | 1013 | asUfsgudTu(C2p)auucuuAfaUfucuuuscsc | 1372 | GGAAAGAAUAAAGAAUGAAACAA | 1731 |
| AD-1136253.1 | gsasaugaAfaCfAfAfauucaagguuL96 | 1014 | asAfsccuUfgaauuugUfuUfcauucsusu | 1373 | AAGAAUGAAACAAAUUCAAGGUU | 1732 |
| AD-1136254.1 | asusgaaaCfaAfAfUfucaagguuauL96 | 1015 | asUfsaadCc(Tgn)ugaauuUfgUfuucaususc | 1374 | GAAUGAAACAAAUUCAAGGUUAA | 1733 |
| AD-1136255.1 | asascaaaUfuCfAfAfgguuaauuguL96 | 1016 | asCfsaauUfaaccuugAfaUfuuguususc | 1375 | GAAACAAAUUCAAGGUUAAUUGG | 1734 |
| AD-1136256.1 | usgsaagcUfgCfAfUfaaagcaagauL96 | 1017 | asUfscudTg(C2p)uuuaugCfaGfcuucascsa | 1376 | UGUGAAGCUGCAUAAAGCAAGAU | 1735 |
| AD-1136257.1 | asasgcugCfaUfAfAfagcaagauuuL96 | 1018 | asAfsaudCu(Tgn)gcuuuaUfgCfagcuuscsa | 1377 | UGAAGCUGCAUAAAGCAAGAUUA | 1736 |
| AD-1136258.1 | asgscugcAfuAfAfAfgcaagauauL96 | 1019 | asUfsaadTc(Tgn)ugcuuuAfuUfcagcususc | 1378 | GAAGCUGCAUAAAGCAAGAUUAC | 1737 |
| AD-1136259.1 | gscsugcaUfaAfAfGfcaagauuacuL96 | 1020 | asGfsuadAu(C2p)uugcuuUfaUfgcagcsusu | 1379 | AAGCUGCAUAAAGCAAGAUUACU | 1738 |
| AD-1136260.1 | csusgcauAfaAfGfCfaagauuacuuL96 | 1021 | asAfsguaAfucuugcuUfuAfugcagscsu | 1380 | AGCUGCAUAAAGCAAGAUUACUC | 1739 |
| AD-1136261.1 | usgscauaAfaGfCfAfagauuacucuL96 | 1022 | asGfsaguAfaucuugcUfuUfaugcasgsc | 1381 | GCUGCAUAAAGCAAGAUUACUCU | 1740 |
| AD-1136262.1 | csasuaaaGfcAfAfGfauuacucuauL96 | 1023 | asUfsagdAg(Tgn)aaucuuGfcUfuuaugscsa | 1382 | UGCAUAAAGCAAGAUUACUCUAU | 1741 |
| AD-1136263.1 | usasaagcAfaGfAfUfuacucuauauL96 | 1024 | asUfsaudAg(Agn)guaaucUfuGfcuuuasusg | 1383 | CAUAAAGCAAGAUUACUCUAUAA | 1742 |
| AD-1136264.1 | asusacaaAfaAfUfCfcaaccaacuuL96 | 1025 | asAfsgudTg(G2p)uuggauUfuUfuguaususa | 1384 | UAAUACAAAAAUCCAACCAACUC | 1743 |
| AD-1136265.1 | usascaaaAfaUfCfCfaaccaacucuL96 | 1026 | asGfsagdTu(G2p)guuggaUfuUfuuguasusu | 1385 | AAUACAAAAAUCCAACCAACUCA | 1744 |
| AD-1136266.1 | ascsaaaaAfuCfCfAfaccaacucauL96 | 1027 | asUfsgadGu(Tgn)gguugGfAfuUfuuugusasu | 1386 | AUACAAAAAUCCAACCAACUCAA | 1745 |
| AD-1136267.1 | csasaaaaUfcCfAfAfccaacucaauL96 | 1028 | asUfsugdAg(Tgn)uguugGfaUfuuuugsusa | 1387 | UACAAAAAUCCAACCAACUCAAU | 1746 |
| AD-1136268.1 | asasaaauCfcAfAfCfcaacucaauuL96 | 1029 | asAfsuudGa(G2p)uugguuGfgAfuuuusgsu | 1388 | ACAAAAAUCCAACCAACUCAAUU | 1747 |
| AD-1136269.1 | asasaaucCfaAfCfCfaacucaauuuL96 | 1030 | asAfsaudTg(Agn)guugguUfgGfauuususg | 1389 | CAAAAAUCCAACCAACUCAAUUA | 1748 |
| AD-1136270.1 | asasaauccAfaCfCfAfacucaauuauL96 | 1031 | asUfsaadTu(G2p)aguuggUfuGfgauususu | 1390 | AAAAAUCCAACCAACUCAAUUAU | 1749 |
| AD-1136271.1 | asasuccaAfcCfAfAfcucaauuauuL96 | 1032 | asAfsuaaUfugaguugGfuUfggauususu | 1391 | AAAAUCCAACCAACUCAAUUAUU | 1750 |
| AD-1136272.1 | asusccaaCfcAfAfCfucaauuauauL96 | 1033 | asAfsauaUfuugaguuGfgAfuuggaususg | 1392 | AAAUCCAACCAACUCAAUUAUUG | 1751 |
| AD-1136273.1 | uscscaacCfaAfCfUfcaauuauuguL96 | 1034 | asCfsaauAfauugaguUfgGfuuggasusu | 1393 | AAUCCAACCAACUCAAUUAUUGA | 1752 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136274.1 | cscsaaccAfaCfUfCfaauuauugauL96 | 1035 | asUfscaaUfaauugagUfuGfguuggsasu | 1394 | AUCCAACCAACUCAAUUAUUGAG | 1753 |
| AD-1136275.1 | csasaccaAfcUfCfAfauuauugaguL96 | 1036 | asCfsucaAfuaauugaGfuUfgguugsgsa | 1395 | UCCAACCAACUCAAUUAUUGAGC | 1754 |
| AD-1136276.1 | asasccaaCfuCfAfAfuuauugagcuL96 | 1037 | asGfscucAfauaauugAfgUfugguusgsg | 1396 | CCAACCAACUCAAUUAUUGAGCA | 1755 |
| AD-1136277.1 | ascscaacUfcAfAfUfuauugagcauL96 | 1038 | asUfsgcdTc(Agn)auaauuGfaGfuugguususg | 1397 | CAACCAACUCAAUUAUUGAGCAC | 1756 |
| AD-1136278.1 | cscsaacuCfaAfUfUfauugagcacuL96 | 1039 | asGfsugdCu(C2p)aauaauUfgAfguuggsusu | 1398 | AACCAACUCAAUUAUUGAGCACG | 1757 |
| AD-1136279.1 | csgsuacaAfuGfUfUfcuagauuucuL96 | 1040 | asGfsaadAu(C2p)uagaacAfuUfguacgsusg | 1399 | CACGUACAAUGUUCUAGAUUUCU | 1758 |
| AD-1136280.1 | gsusacaaUfgUfUfCfuagauuucuuL96 | 1041 | asAfsgaaAfucuagaaCfaUfguacsgsu | 1400 | ACGUACAAUGUUCUAGAUUUCUU | 1759 |
| AD-1136281.1 | usascaauGfuUfCfUfagauuucuuuL96 | 1042 | asAfsagaAfaucuagaAfcAfuuguascsg | 1401 | CGUACAAUGUUCUAGAUUUCUUU | 1760 |
| AD-1136282.1 | ascsaaugUfuCfUfAfgauuucuuuL96 | 1043 | asAfsaagAfaaucuagAfaCfauugusasc | 1402 | GUACAAUGUUCUAGAUUUCUUUC | 1761 |
| AD-1136283.1 | csasauguUfcUfAfGfauuucuuucuL96 | 1044 | asGfsaaaGfaaaucuaGfaAfcauugsusa | 1403 | UACAAUGUUCUAGAUUUCUUUCC | 1762 |
| AD-1136284.1 | asasauguuCfuAfGfAfuuucuuuccuL96 | 1045 | asGfsgaaAfgaaaucuAfgAfacauusgsu | 1404 | ACAAUGUUCUAGAUUUCUUUCC | 1763 |
| AD-1136285.1 | gsusucuaGfaUfUfUfcuuucccuuuL96 | 1046 | asAfsagdGg(Agn)aagaaaUfcUfagaacsasu | 1405 | AUGUUCUAGAUUUCUUUCCCUUC | 1764 |
| AD-1136286.1 | ususcuagAfuUfUfCfuuucccuucuL96 | 1047 | asGfsaadGg(G2p)aaagaaaUfuCfuagaascsa | 1406 | UGUUCUAGAUUUCUUUCCCUUCC | 1765 |
| AD-1136287.1 | uscsuuuaCfuUfUfUfgaagccaauL96 | 1048 | asUfsuudGg(C2p)uucaaaUfgUfaaagasusu | 1407 | AAUCUUUACAUUUGAAGCCAAAG | 1766 |
| AD-1136288.1 | csusuuacAfuUfUfGfaagccaaaguL96 | 1049 | asCfsuudTg(G2p)cuucaaAfuGfuaaagsasu | 1408 | AUCUUUACAUUUGAAGCCAAAGU | 1767 |
| AD-1136289.1 | ususuacaUfuUfGfAfagccaaaguuL96 | 1050 | asAfscudTu(G2p)gcuucaAfaUfguaaasgsa | 1409 | UCUUUACAUUUGAAGCCAAAGUA | 1768 |
| AD-1136290.1 | ascsauuuGfaAfGfCfcaaaguaauuL96 | 1051 | asAfsuudAc(Tgn)uuggcuUfcAfaauguasasa | 1410 | UUACAUUUGAAGCCAAAGUAAUU | 1769 |
| AD-1136291.1 | asusuugaAfgCfCfAfaaguaauuuL96 | 1052 | asAfsaauUfacuuuggCfuUfcaaausgsu | 1411 | ACAUUUGAAGCCAAAGUAAUUUC | 1770 |
| AD-1136292.1 | gsasagccAfaAfGfUfaauuuccacuL96 | 1053 | asGfsuggAfaauuacuUfuGfgcuucsasa | 1412 | UUGAAGCCAAAGUAAUUUCCAC | 1771 |
| AD-1136293.1 | asasagccAfaGfUfAfauuuccaccuL96 | 1054 | asGfsgudGg(Agn)aauuacUfuUfggcuuscsa | 1413 | UGAAGCCAAAGUAAUUUCCACCU | 1772 |
| AD-1136294.1 | cscsaaagUfaAfUfUfuccaccuaguL96 | 1055 | asCfsuadGg(Tgn)ggaaauUfaCfuuugsgscsu | 1414 | AGCCAAAGUAAUUUCCACCUAGA | 1773 |
| AD-1136295.1 | csasaaguAfaUfUfUfccaccuagauL96 | 1056 | asUfscudAg(G2p)uggaaaUfuAfcuuugsgsc | 1415 | GCCAAAGUAAUUUCCACCUAGAA | 1774 |
| AD-1136296.1 | asasaguaAfuUfUfCfcaccuagauL96 | 1057 | asUfsucdTa(G2p)guggaaAfuUfacuuusgsg | 1416 | CCAAAGUAAUUUCCACCUAGAA | 1775 |
| AD-1136297.1 | gscsaagaUfcUfUfGfucucugaaguL96 | 1058 | asCfsuucAfgagacaaGfaUfcuugcsusc | 1417 | GAGCAAGAUCUUGUCUCUGAAGA | 1776 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136298.1 | asgsguagAfaGfAfGfccaagaagcuL96 | 1059 | asGfscudTc(Tgn)uggcucUfuCfuaccuscsu | 1418 | AGAGGUAGAAGAGCCAAGAAGCC | 1777 |
| AD-1136299.1 | csusagcuCfuGfUfCfucuucugucuL96 | 1060 | asGfsacaGfaagagacAfgAfgcuagsgsa | 1419 | UCCUAGCUCUGUCUCUUCUGUCU | 1778 |
| AD-1136300.1 | usasgcucUfgUfCfUfcucucgucuuL96 | 1061 | asAfsgadCa(G2p)aagagaCfaGfagcuasgsg | 1420 | CCUAGCUCUGUCUCUUCUGUCUC | 1779 |
| AD-1136301.1 | asgscucuGfuCfUfCfuucugucucuL96 | 1062 | asGfsagdAc(Agn)gaagagAfcAfgagcusasg | 1421 | CUAGCUCUGUCUCUUCUGUCUCU | 1780 |
| AD-1136302.1 | asuscuuuGfuGfAfUfcuuggacuguL96 | 1063 | asCfsaguCfcaagaucAfcAfaagausasg | 1422 | CUAUCUUUGUGAUCUUGGACUGU | 1781 |
| AD-1136303.1 | csusuccuGfuGfAfUfccauuuuacuL96 | 1064 | asGfsuaaAfauggaucAfcAfggaagsgsg | 1423 | CCCUUCCUGUGAUCCAUUUUACU | 1782 |
| AD-1136304.1 | ususccugUfgAfUfCfcauuuuacuuL96 | 1065 | asAfsguaAfaauggauCfaCfaggaasgsg | 1424 | CCUUCCUGUGAUCCAUUUUACUG | 1783 |
| AD-1136305.1 | uscscuguGfaUfCfCfauuuuacuguL96 | 1066 | asCfsaguAfaauggaUfcAfcaggasasg | 1425 | CUUCCUGUGAUCCAUUUUACUGC | 1784 |
| AD-1136306.1 | cscscugugAfuCfCfAfuuuuacugcuL96 | 1067 | asGfscagUfaaaauggAfuCfacaggsasa | 1426 | UUCCUGUGAUCCAUUUUACUGCA | 1785 |
| AD-1136307.1 | csusgugaUfcCfAfUfuuuacugcauL96 | 1068 | asUfsgcdAg(Tgn)aaaaugGfaUfcacagsgsa | 1427 | UCCUGUGAUCCAUUUUACUGCAA | 1786 |
| AD-1136308.1 | csusauaaAfuAfUfAfugaccugaauL96 | 1069 | asUfsucdAg(G2p)ucauauAfuUfuauagsgsc | 1428 | GCCUAUAAAUAUGACCUGAAA | 1787 |
| AD-1136309.1 | usgsaccuGfaAfAfAfcuccaguuauL96 | 1070 | asUfsaadCu(G2p)gaguuuUfcAfggucasusa | 1429 | UAUGACCUGAAAACUCCAGUUAC | 1788 |
| AD-1136310.1 | gsasccugAfaAfAfCfuccaguuacuL96 | 1071 | asGfsuadAc(Tgn)ggaguuUfuCfaggucsasu | 1430 | AUGACCUGAAAACUCCAGUUACA | 1789 |
| AD-1136311.1 | asasgggauCfuGfCfAfgcuaucuaauL96 | 1072 | asUfsuadGa(Tgn)agcugcAfgAfuccuususa | 1431 | UAAAGGAUCUGCAGCUAUCUAAG | 1790 |
| AD-1136312.1 | asgsgaucUfgCfAfGfcuaucuaaguL96 | 1073 | asCfsuuaGfauagcugCfaGfauccusususu | 1432 | AAAGGAUCUGCAGCUAUCUAAGG | 1791 |
| AD-1136313.1 | gscsuaucUfaAfGfGfcuugguuuuuL96 | 1074 | asAfsaaaCfcaagccuUfaGfauagcsusug | 1433 | CAGCUAUCUAAGGCUUGGUUUUC | 1792 |
| AD-1136314.1 | csusaucuAfaGfGfCfuuggauuuucuL96 | 1075 | asGfsaaaAfccaagccUfuAfgauagscsu | 1434 | AGCUAUCUAAGGCUUGGUUUUCU | 1793 |
| AD-1136315.1 | asuscuaaGfgCfUfUfgguuuucuuuL96 | 1076 | asAfsagaAfaaccaagCfcUfuagausasg | 1435 | CUAUCUAAGGCUUGGUUUUCUUA | 1794 |
| AD-1136316.1 | uscsuaagGfcUfUfGfguuuucuuauL96 | 1077 | asUfsaadGa(Agn)aaccaaGfcCfuuagasusa | 1436 | UAUCUAAGGCUUGGUUUUCUUAC | 1795 |
| AD-1136317.1 | csusaaggCfuUfGfGfuuuucuuacuL96 | 1078 | asGfsuaaGfaaaaccaAfgCfcuuagsasu | 1437 | AUCUAAGGCUUGGUUUUCUUACU | 1796 |
| AD-1136318.1 | ussaaggcUfuGfGfUfuuucuuacuuL96 | 1079 | asAfsguaAfgaaaaccAfaGfccuuasgsa | 1438 | UCUAAGGCUUGGUUUUCUUACUG | 1797 |
| AD-1136319.1 | gsgscuugGfuUfUfUfcuuacuguuuL96 | 1080 | asGfsacdAg(Tgn)aagaaaAfcCfaagcsusu | 1439 | AAGGCUUGGUUUUCUUACUGUCA | 1798 |
| AD-1136320.1 | gscsuuggUfuUfUfCfuuacugucauL96 | 1081 | asUfsgadCa(G2p)uaagaaAfaCfcaagscscsu | 1440 | AGGCUUGGUUUUCUUACUGUCAU | 1799 |
| AD-1136321.1 | csusugguUfuUfCfUfuacugucauuL96 | 1082 | asAfsugdAc(Agn)guaagaAfaAfccaagscsc | 1441 | GGCUUGGUUUUCUUACUGUCAUA | 1800 |

TABLE 3-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136322.1 | ususgguuUfuCfUfUfacugucauauL96 | 1083 | asUfsaudGa(C2p)aguaagAfaAfaccaasgsc | 1442 | GCUUGGUUUUCUUACUGUCAUAU | 1801 |
| AD-1136323.1 | usgsguuUfcUfUfAfcugucauauuL96 | 1084 | asAfsuadTg(Agn)caguaaGfaAfaccasasg | 1443 | CUUGGUUUUCUUACUGUCAUAUG | 1802 |
| AD-1136324.1 | gsgsuuuuCfUfUfAfCfugucauauguL96 | 1085 | asCfsauaUfgacaguaAfgAfaaaccsasa | 1444 | UUGGUUUUCUUACUGUCAUAUGA | 1803 |
| AD-1136325.1 | ususuucuUfaCfUfGfucauaugauuL96 | 1086 | asAfsucaUfaugacagUfaAfgaaaascsc | 1445 | GGUUUUCUUACUGUCAUAUGAUA | 1804 |
| AD-1136326.1 | ususucuuAfcUfGfUfcauaugauauL96 | 1087 | asUfsaucAfuaugacaGfuAfagaaasasc | 1446 | GUUUUCUUACUGUCAUAUGAUAC | 1805 |
| AD-1136327.1 | uscsuuacUfgUfCfAfuaugauaccuL96 | 1088 | asGfsgudAu(C2p)auaugaCfaGfuaagasasa | 1447 | UUUCUUACUGUCAUAUGAUACCU | 1806 |
| AD-1136328.1 | csusuacuGfuCfAfUfaugauaccuuL96 | 1089 | asAfsgguAfucauaugAfcAfguaagsasa | 1448 | UUCUUACUGUCAUAUGAUACCUG | 1807 |
| AD-1136329.1 | uscsugcgGfuUfGfGfuaaagagaauL96 | 1090 | asUfsucdTc(Tgn)uuaccaAfcCfgcagasasa | 1449 | UUUCUGCGGUUGGUAAAGAGAAC | 1808 |
| AD-1136330.1 | usgsgugaUfuUfAfAfucccuacauuL96 | 1091 | asAfsgudTa(G2p)ggauuaAfaUfcaccasusu | 1450 | AAUGGUGAUUUAAUCCCUACAUG | 1809 |
| AD-1136331.1 | gsgsugauUfuAfAfUfcccuacauguL96 | 1092 | asCfsaugUfagggauuAfaAfucaccsasu | 1451 | AUGGUGAUUUAAUCCCUACAUGG | 1810 |
| AD-1136332.1 | usgsuauaAfaUfCfCfaaccuucuguL96 | 1093 | asCfsagaAfgguuggaUfuUfauacasgsu | 1452 | ACUGUAUAAAUCCAACCUUCUGC | 1811 |
| AD-1136333.1 | gsusgcuuGfaUfGfUfcacuaauaauL96 | 1094 | asUfsuadTu(Agn)gugacaUfcAfagcacscsa | 1453 | UGGUGCUUGAUGUCACUAAUAAA | 1812 |
| AD-1136334.1 | usgscuugAfuGfUfCfacuaauaaauL96 | 1095 | asUfsuuaUfuagugacAfuCfaagcascsc | 1454 | GGUGCUUGAUGUCACUAAUAAAU | 1813 |
| AD-1136335.1 | gscsuugaUfgUfCfAfcuaauaaauuL96 | 1096 | asAfsuuuAfuuagugaCfaUfcaagcsasc | 1455 | GUGCUUGAUGUCACUAAUAAAUG | 1814 |
| AD-1136336.1 | asusugucaCfuAfAfUfaaaugaaacuL96 | 1097 | asGfsuudTc(Agn)uuuauuAfgUfgacauscsa | 1456 | UGAUGUCACUAAUAAAUGAAACU | 1815 |
| AD-1136337.1 | usgsucacUfaAfUfAfaaugaaacuuL96 | 1098 | asAfsgudTu(C2p)auuuauUfaGfugacasusc | 1457 | GAUGUCACUAAUAAAUGAAACUG | 1816 |
| AD-1136338.1 | usasauaaAfuGfAfAfacugucagcuL96 | 1099 | asGfscudGa(C2p)aguucAfuUfuauuasgsu | 1458 | ACUAAUAAAUGAAACUGUCAGCU | 1817 |

TABLE 4

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1135979.1 | 78.6 | 8.5 | 81.4 | 6.5 | 68.6 | 25.5 |
| AD-1135980.1 | 98.2 | 10.7 | 92.0 | 18.8 | 64.8 | 1.2 |
| AD-1135981.1 | 79.5 | 14.5 | 92.4 | 19.2 | 60.7 | 9.1 |
| AD-1135982.1 | 66.7 | 6.7 | 80.3 | 6.8 | 67.5 | 4.1 |
| AD-1135983.1 | 68.7 | 9.7 | 75.0 | 3.5 | 62.8 | 6.8 |
| AD-1135984.1 | 69.4 | 14.9 | 66.0 | 5.0 | 68.3 | 13.1 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1135985.1 | 59.8 | 10.9 | 69.5 | 26.8 | 69.2 | 9.4 |
| AD-1135986.1 | 94.2 | 30.7 | 54.0 | 21.9 | 58.0 | 7.8 |
| AD-1135987.1 | 29.0 | 5.3 | 47.3 | 10.4 | 44.4 | 7.8 |
| AD-1135988.1 | 82.4 | 15.5 | 85.9 | 4.8 | 63.9 | 1.9 |
| AD-1135989.1 | 36.6 | 8.6 | 58.0 | 10.7 | 52.9 | 3.2 |
| AD-1135990.1 | 86.8 | 31.4 | 94.2 | 5.1 | 73.2 | 16.0 |
| AD-1135991.1 | 36.0 | 6.7 | 45.8 | 9.5 | 54.3 | 9.2 |
| AD-1135992.1 | 66.2 | 18.6 | 81.8 | 9.3 | 78.3 | 14.7 |
| AD-1135993.1 | 68.7 | 16.2 | 56.9 | 17.0 | 62.7 | 7.4 |
| AD-1135994.1 | 60.5 | 21.8 | 71.3 | 22.4 | 70.5 | 18.1 |
| AD-1135995.1 | 51.2 | 5.0 | 76.5 | 6.1 | 54.8 | 6.4 |
| AD-1135996.1 | 38.6 | 8.3 | 56.5 | 8.9 | 54.8 | 7.4 |
| AD-1135997.1 | 63.7 | 13.1 | 78.9 | 6.3 | 67.4 | 7.1 |
| AD-1135998.1 | 45.7 | 6.7 | 42.2 | 3.3 | 59.4 | 18.4 |
| AD-1135999.1 | 39.8 | 6.5 | 61.4 | 10.2 | 67.1 | 14.9 |
| AD-1136000.1 | 59.6 | 8.2 | 60.7 | 15.3 | 58.8 | 4.7 |
| AD-1136001.1 | 29.4 | 7.6 | 42.2 | 11.7 | 47.3 | 3.1 |
| AD-1136002.1 | 35.2 | 6.9 | 35.1 | 6.1 | 36.4 | 6.1 |
| AD-1136003.1 | 59.4 | 9.1 | 55.3 | 8.4 | 51.2 | 7.4 |
| AD-1136004.1 | 39.8 | 4.4 | 59.7 | 4.9 | 62.2 | 12.8 |
| AD-1136005.1 | 74.9 | 7.7 | 97.7 | 35.8 | 81.3 | 11.8 |
| AD-1136006.1 | 53.9 | 7.3 | 87.2 | 11.7 | 68.6 | 11.2 |
| AD-1136007.1 | 34.0 | 7.7 | 55.2 | 5.3 | 55.5 | 2.9 |
| AD-1136008.1 | 26.6 | 9.2 | 46.9 | 22.0 | 55.4 | 9.7 |
| AD-1136009.1 | 41.9 | 11.4 | 69.5 | 25.5 | 65.4 | 10.1 |
| AD-1136010.1 | 86.3 | 20.6 | 100.7 | 20.6 | 77.0 | 10.3 |
| AD-1136011.1 | 84.9 | 11.0 | 91.8 | 14.5 | 63.6 | 6.0 |
| AD-1136012.1 | 43.6 | 11.3 | 59.6 | 4.9 | 67.0 | 8.4 |
| AD-1136013.1 | 74.1 | 8.8 | 96.5 | 30.1 | 68.6 | 13.1 |
| AD-1136014.1 | 82.1 | 16.3 | 83.9 | 13.5 | 68.5 | 6.9 |
| AD-1136015.1 | 47.4 | 6.1 | 78.1 | 3.4 | 67.1 | 10.2 |
| AD-1136016.1 | 45.3 | 19.8 | 69.7 | 10.5 | 63.3 | 5.7 |
| AD-1136017.1 | 41.3 | 5.8 | 77.8 | 14.2 | 59.2 | 4.0 |
| AD-1136018.1 | 47.4 | 10.9 | 64.5 | 11.1 | 64.4 | 10.8 |
| AD-1136019.1 | 85.6 | 9.7 | 97.4 | 9.3 | 67.8 | 2.9 |
| AD-1136020.1 | 54.7 | 8.5 | 68.9 | 9.4 | 59.7 | 1.8 |
| AD-1136021.1 | 40.9 | 16.6 | 60.7 | 5.1 | 71.3 | 24.0 |
| AD-1136022.1 | 43.0 | 8.0 | 57.9 | 12.5 | 62.5 | 9.2 |
| AD-1136023.1 | 46.1 | 20.5 | 71.9 | 8.1 | 60.6 | 4.8 |
| AD-1136024.1 | 43.4 | 3.0 | 68.9 | 12.2 | 57.3 | 15.8 |
| AD-1136025.1 | 61.1 | 9.2 | 74.0 | 6.2 | 69.6 | 13.1 |
| AD-1136026.1 | 108.6 | 14.0 | 107.0 | 13.2 | 75.9 | 11.1 |
| AD-1136027.1 | 120.4 | 32.7 | 104.1 | 23.0 | 77.3 | 11.7 |
| AD-1136028.1 | 84.3 | 14.0 | 101.4 | 13.8 | 71.1 | 2.5 |
| AD-1136029.1 | 120.4 | 32.1 | 94.0 | 7.1 | 86.3 | 17.7 |
| AD-1136030.1 | 37.1 | 4.1 | 48.1 | 4.1 | 56.4 | 4.2 |
| AD-1136031.1 | 55.4 | 26.1 | 75.1 | 14.6 | 69.7 | 16.4 |
| AD-1136032.1 | 33.4 | 7.4 | 47.8 | 10.1 | 38.4 | 3.3 |
| AD-1136033.1 | 57.6 | 20.1 | 77.1 | 7.3 | 60.6 | 4.2 |
| AD-1136034.1 | 51.7 | 9.7 | 59.4 | 9.0 | 63.8 | 6.7 |
| AD-1136035.1 | 58.2 | 10.8 | 89.8 | 10.8 | 64.4 | 3.0 |
| AD-1136036.1 | 50.8 | 6.1 | 63.8 | 4.7 | 65.1 | 12.6 |
| AD-1136037.1 | 41.8 | 7.7 | 50.4 | 3.1 | 64.3 | 17.4 |
| AD-1136038.1 | 29.8 | 12.3 | 46.9 | 2.6 | 46.6 | 8.7 |
| AD-1136039.1 | 28.7 | 11.8 | 37.0 | 5.6 | 64.7 | 29.0 |
| AD-1136040.1 | 49.1 | 7.4 | 87.9 | 12.5 | 57.7 | 21.1 |
| AD-1136041.1 | 66.6 | 18.3 | 99.9 | 8.1 | 78.2 | 14.9 |
| AD-1136042.1 | 45.1 | 15.3 | 72.3 | 5.2 | 77.1 | 17.8 |
| AD-1136043.1 | 37.3 | 21.7 | 53.9 | 6.4 | 60.2 | 9.1 |
| AD-1136044.1 | 74.8 | 24.4 | 106.8 | 8.2 | 76.4 | 8.0 |
| AD-1136045.1 | 43.6 | 10.2 | 92.3 | 15.6 | 69.8 | 12.7 |
| AD-1136046.1 | 36.5 | 10.3 | 66.8 | 5.5 | 75.4 | 12.4 |
| AD-1136047.1 | 40.5 | 10.3 | 71.0 | 9.0 | 67.4 | 19.4 |
| AD-1136048.1 | 48.8 | 14.4 | 60.1 | 7.6 | 57.8 | 7.1 |
| AD-1136049.1 | 82.5 | 19.0 | 91.0 | 17.0 | 63.6 | 6.6 |
| AD-1136050.1 | 50.0 | 4.6 | 73.8 | 14.9 | 62.4 | 4.0 |
| AD-1136051.1 | 28.7 | 1.3 | 44.3 | 7.6 | 47.7 | 8.2 |
| AD-1136052.1 | 27.2 | 7.6 | 55.7 | 11.4 | 49.6 | 3.7 |
| AD-1136053.1 | 33.6 | 22.8 | 49.1 | 7.9 | 54.4 | 4.7 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1136054.1 | 41.4 | 21.2 | 61.3 | 6.3 | 55.8 | 6.9 |
| AD-1136055.1 | 58.3 | 16.1 | 78.4 | 6.8 | 63.1 | 9.9 |
| AD-1136056.1 | 50.5 | 13.4 | 76.7 | 10.5 | 65.5 | 11.3 |
| AD-1136057.1 | 47.0 | 13.0 | 70.4 | 15.6 | 55.4 | 2.8 |
| AD-1136058.1 | 47.9 | 10.2 | 83.8 | 6.9 | 65.6 | 11.6 |
| AD-1136059.1 | 76.2 | 14.1 | 95.4 | 17.7 | 67.3 | 11.0 |
| AD-1136060.1 | 48.0 | 17.1 | 79.8 | 14.6 | 68.9 | 14.5 |
| AD-1136061.1 | 28.0 | 5.2 | 53.9 | 10.6 | 53.8 | 13.6 |
| AD-1136062.1 | 42.1 | 10.4 | 55.4 | 7.3 | 56.7 | 4.8 |
| AD-1136063.1 | 90.1 | 40.7 | 79.3 | 2.8 | 62.9 | 11.6 |
| AD-1136064.1 | 58.7 | 14.6 | 77.9 | 3.2 | 72.4 | 16.2 |
| AD-1136065.1 | 78.2 | 16.0 | 83.8 | 11.7 | 62.9 | 6.1 |
| AD-1136066.1 | 50.9 | 17.0 | 74.0 | 7.0 | 64.3 | 13.4 |
| AD-1136067.1 | 60.6 | 11.1 | 78.6 | 5.1 | 60.6 | 7.6 |
| AD-1136068.1 | 46.9 | 20.3 | 64.2 | 8.0 | 57.4 | 3.4 |
| AD-1136069.1 | 33.5 | 10.4 | 34.8 | 10.9 | 54.5 | 4.7 |
| AD-1136070.1 | 33.7 | 5.6 | 38.2 | 6.2 | 55.9 | 12.2 |
| AD-1136071.1 | 43.7 | 7.9 | 47.8 | 5.6 | 82.7 | 10.9 |
| AD-1136072.1 | 53.1 | 16.0 | 52.0 | 15.3 | 82.5 | 4.1 |
| AD-1136073.1 | 37.8 | 9.0 | 38.5 | 9.0 | 56.7 | 11.1 |
| AD-1136074.1 | 59.0 | 7.7 | 56.7 | 13.9 | 53.4 | 14.8 |
| AD-1136075.1 | 25.9 | 5.2 | 36.6 | 6.8 | 32.5 | 10.8 |
| AD-1136076.1 | 38.0 | 11.5 | 40.0 | 15.3 | 42.6 | 9.8 |
| AD-1136077.1 | 33.2 | 4.7 | 39.2 | 10.9 | 70.9 | 15.7 |
| AD-1136078.1 | 53.5 | 7.7 | 59.0 | 4.6 | 84.5 | 5.9 |
| AD-1136079.1 | 52.0 | 18.0 | 63.3 | 13.1 | 91.1 | 12.3 |
| AD-1136080.1 | 49.3 | 19.0 | 67.8 | 16.7 | 97.7 | 18.9 |
| AD-1136081.1 | 29.0 | 5.4 | 40.0 | 13.8 | 63.7 | 12.3 |
| AD-1136082.1 | 28.9 | 19.2 | 26.2 | 4.5 | 39.4 | 5.4 |
| AD-1136083.1 | 17.6 | 1.9 | 18.7 | 2.7 | 24.6 | 2.9 |
| AD-1136084.1 | 27.4 | 3.7 | 32.3 | 7.8 | 43.4 | 8.6 |
| AD-1136085.1 | 35.0 | 8.9 | 41.8 | 18.1 | 83.9 | 20.0 |
| AD-1136086.1 | 74.4 | 23.0 | 78.3 | 11.0 | 102.6 | 14.3 |
| AD-1136087.1 | 67.6 | 29.6 | 33.7 | 7.6 | 81.8 | 16.9 |
| AD-1136088.1 | 27.4 | 4.9 | 52.3 | 2.4 | 78.4 | 5.9 |
| AD-1136089.1 | 37.2 | 18.0 | 33.6 | 1.7 | 61.0 | 15.7 |
| AD-1136090.1 | 56.0 | 24.2 | 67.8 | 5.6 | 77.0 | 5.9 |
| AD-1136091.1 | 23.2 | 4.3 | 32.6 | 13.8 | 44.2 | 7.7 |
| AD-1136092.1 | 35.3 | 11.0 | 58.7 | 23.6 | 87.8 | 22.4 |
| AD-1136093.1 | 44.8 | 11.5 | 43.7 | 14.0 | 81.5 | 18.1 |
| AD-1136094.1 | 47.6 | 12.0 | 47.8 | 9.7 | 94.1 | 28.6 |
| AD-1136095.1 | 69.2 | 14.9 | 69.7 | 8.4 | 96.6 | 11.1 |
| AD-1136096.1 | 67.0 | 21.6 | 73.8 | 5.2 | 94.4 | 4.7 |
| AD-1136097.1 | 84.8 | 9.5 | 76.0 | 8.6 | 93.5 | 15.0 |
| AD-1136098.1 | 58.1 | 3.2 | 49.0 | 3.3 | 74.4 | 15.8 |
| AD-1136099.1 | 63.7 | 17.1 | 72.7 | 21.6 | 112.8 | 14.8 |
| AD-1136100.1 | 40.7 | 4.6 | 39.7 | 9.2 | 76.0 | 13.5 |
| AD-1136101.1 | 49.5 | 11.9 | 39.8 | 3.4 | 67.2 | 2.7 |
| AD-1136102.1 | 49.3 | 3.4 | 40.5 | 4.4 | 77.7 | 11.2 |
| AD-1136103.1 | 44.7 | 6.8 | 49.9 | 4.6 | 82.0 | 11.3 |
| AD-1136104.1 | 56.9 | 13.7 | 52.9 | 5.4 | 87.6 | 5.3 |
| AD-1136105.1 | 69.7 | 29.4 | 60.4 | 10.7 | 79.9 | 9.4 |
| AD-1136106.1 | 28.3 | 8.4 | 36.9 | 7.8 | 54.4 | 9.8 |
| AD-1136107.1 | 35.4 | 8.3 | 61.2 | 18.1 | 84.4 | 3.2 |
| AD-1136108.1 | 49.1 | 20.7 | 49.7 | 12.8 | 75.4 | 17.4 |
| AD-1136109.1 | 65.0 | 17.5 | 63.6 | 10.2 | 95.5 | 10.9 |
| AD-1136110.1 | 121.2 | 18.0 | 91.7 | 14.5 | 102.9 | 7.7 |
| AD-1136111.1 | 85.6 | 9.1 | 80.8 | 17.2 | 96.8 | 12.5 |
| AD-1136112.1 | 49.6 | 3.0 | 46.6 | 8.9 | 72.9 | 12.9 |
| AD-1136114.1 | 45.2 | 9.2 | 37.7 | 18.3 | 71.0 | 4.6 |
| AD-1136115.1 | 76.2 | 8.7 | 80.3 | 16.2 | 94.8 | 6.0 |
| AD-1136116.1 | 108.7 | 15.0 | 105.2 | 23.4 | 119.1 | 31.1 |
| AD-1136117.1 | 45.8 | 8.8 | 37.1 | 4.1 | 56.7 | 6.1 |
| AD-1136118.1 | 51.8 | 12.1 | 43.7 | 10.2 | 64.7 | 8.0 |
| AD-1136119.1 | 68.7 | 9.8 | 53.1 | 7.7 | 83.8 | 6.9 |
| AD-1136120.1 | 54.9 | 7.9 | 45.6 | 5.9 | 80.8 | 20.4 |
| AD-1136121.1 | 52.4 | 19.3 | 64.3 | 12.8 | 79.1 | 19.4 |
| AD-1136122.1 | 103.8 | 15.0 | 91.1 | 13.4 | 113.7 | 22.7 |
| AD-1136123.1 | 57.7 | 5.0 | 62.6 | 13.3 | 95.9 | 7.3 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1136124.1 | 69.7 | 5.7 | 74.6 | 5.3 | 96.5 | 21.5 |
| AD-1136125.1 | 47.0 | 9.3 | 49.2 | 5.0 | 75.2 | 20.0 |
| AD-1136126.1 | 58.9 | 1.7 | 57.8 | 13.0 | 84.7 | 9.7 |
| AD-1136127.1 | 50.2 | 11.1 | 33.2 | 5.1 | 58.2 | 5.2 |
| AD-1136128.1 | 111.8 | 17.4 | 81.9 | 3.7 | 104.2 | 25.1 |
| AD-1136129.1 | 77.6 | 34.6 | 100.1 | 45.8 | 79.2 | 12.9 |
| AD-1136130.1 | 51.5 | 2.4 | 62.2 | 9.0 | 98.9 | 17.0 |
| AD-1136131.1 | 78.0 | 13.8 | 66.1 | 4.7 | 95.2 | 12.6 |
| AD-1136132.1 | 73.5 | 9.3 | 68.8 | 3.1 | 104.0 | 12.2 |
| AD-1136133.1 | 65.9 | 4.8 | 66.8 | 16.8 | 89.7 | 9.7 |
| AD-1136134.1 | 72.8 | 13.6 | 57.5 | 4.6 | 84.9 | 5.0 |
| AD-1136135.1 | 57.0 | 17.8 | 59.3 | 9.0 | 86.4 | 6.9 |
| AD-1136136.1 | 49.1 | 25.8 | 58.5 | 4.6 | 63.5 | 7.5 |
| AD-1136137.1 | 50.4 | 8.5 | 57.1 | 18.7 | 91.4 | 19.0 |
| AD-1136138.1 | 83.8 | 21.2 | 72.2 | 13.5 | 92.9 | 7.0 |
| AD-1136139.1 | 44.6 | 9.9 | 39.8 | 7.5 | 60.0 | 10.4 |
| AD-1136140.1 | 75.1 | 8.6 | 64.3 | 2.4 | 89.1 | 11.8 |
| AD-1136141.1 | 36.6 | 3.5 | 30.3 | 2.9 | 61.7 | 13.8 |
| AD-1136142.1 | 38.7 | 11.0 | 38.3 | 7.1 | 63.9 | 4.8 |
| AD-1136143.1 | 34.9 | 13.9 | 46.9 | 16.2 | 66.0 | 23.0 |
| AD-1136144.1 | 39.1 | 6.9 | 50.6 | 2.9 | 75.2 | 16.3 |
| AD-1136145.1 | 58.8 | 3.7 | 55.3 | 7.0 | 84.5 | 19.3 |
| AD-1136146.1 | 69.4 | 4.6 | 67.7 | 12.3 | 93.8 | 12.6 |
| AD-1136147.1 | 118.8 | 30.5 | 93.9 | 15.8 | 99.0 | 8.6 |
| AD-1136148.1 | 65.9 | 17.7 | 62.0 | 4.9 | 82.9 | 3.2 |
| AD-1136149.1 | 60.1 | 23.6 | 43.5 | 4.7 | 81.8 | 7.4 |
| AD-1136150.1 | 30.2 | 6.2 | 43.5 | 12.6 | 86.1 | 10.5 |
| AD-1136151.1 | 47.3 | 10.5 | 70.6 | 23.5 | 66.4 | 9.4 |
| AD-1136152.1 | 56.8 | 25.0 | 63.5 | 18.1 | 70.5 | 25.6 |
| AD-1136153.1 | 52.3 | 8.3 | 49.4 | 13.5 | 77.7 | 7.8 |
| AD-1136154.1 | 47.3 | 17.6 | 49.5 | 5.8 | 85.6 | 20.7 |
| AD-1136155.1 | 106.6 | 1.5 | 76.3 | 15.7 | 92.6 | 6.2 |
| AD-1136156.1 | 36.6 | 9.6 | 50.8 | 32.7 | 65.3 | 8.2 |
| AD-1136157.1 | 30.2 | 16.8 | 36.8 | 15.8 | 67.0 | 8.9 |
| AD-1136158.1 | 54.9 | 10.5 | 68.4 | 15.9 | 78.3 | 18.4 |
| AD-1136159.1 | 27.6 | 5.5 | 50.6 | 19.2 | 93.9 | 20.2 |
| AD-1136160.1 | 31.7 | 5.8 | 53.7 | 16.2 | 121.0 | 34.1 |
| AD-1136161.1 | 32.0 | 5.4 | 62.0 | 25.2 | 68.9 | 9.8 |
| AD-1136162.1 | 27.5 | 4.8 | 46.0 | 10.9 | 98.4 | 37.9 |
| AD-1136163.1 | 21.6 | 7.4 | 33.8 | 6.6 | 52.8 | 26.7 |
| AD-1136164.1 | 47.9 | 25.0 | 64.4 | 13.8 | 81.3 | 9.8 |
| AD-1136165.1 | 31.9 | 6.9 | 62.1 | 2.0 | 56.8 | 11.0 |
| AD-1136166.1 | 20.5 | 3.9 | 35.5 | 6.5 | 52.0 | 26.5 |
| AD-1136167.1 | 55.5 | 10.9 | 88.1 | 31.7 | 87.4 | 8.2 |
| AD-1136168.1 | 53.0 | 3.7 | 64.5 | 18.7 | 91.7 | 31.7 |
| AD-1136169.1 | 27.7 | 2.4 | 32.0 | 6.6 | 50.6 | 7.6 |
| AD-1136170.1 | 28.0 | 2.5 | 39.1 | 16.3 | 61.7 | 6.3 |
| AD-1136171.1 | 78.1 | 6.6 | 54.6 | 21.1 | 96.7 | 4.1 |
| AD-1136172.1 | 43.7 | 9.8 | 58.0 | 19.0 | 82.1 | 7.5 |
| AD-1136173.1 | 34.8 | 6.7 | 62.4 | 10.9 | 78.4 | 9.5 |
| AD-1136174.1 | 29.3 | 6.9 | 59.8 | 15.4 | 61.3 | 22.5 |
| AD-1136175.1 | 39.0 | 6.3 | 57.8 | 26.0 | 70.6 | 16.2 |
| AD-1136176.1 | 71.2 | 7.3 | 64.8 | 22.4 | 107.7 | 18.8 |
| AD-1136177.1 | 66.4 | 5.4 | 64.9 | 27.3 | 90.1 | 8.1 |
| AD-1136178.1 | 47.5 | 8.5 | 61.3 | 17.3 | 87.4 | 8.7 |
| AD-1136179.1 | 45.9 | 2.8 | 45.9 | 15.6 | 80.8 | 17.7 |
| AD-1136180.1 | 56.6 | 18.0 | 59.3 | 7.1 | 66.9 | 5.1 |
| AD-1136181.1 | 28.8 | 5.9 | 41.2 | 4.2 | 35.8 | 3.4 |
| AD-1136182.1 | 66.9 | 34.9 | 82.1 | 28.4 | 129.7 | 48.8 |
| AD-1136183.1 | 100.7 | 16.6 | 54.8 | 18.7 | 105.8 | 8.5 |
| AD-1136184.1 | 72.6 | 9.2 | 51.5 | 8.0 | 113.2 | 16.5 |
| AD-1136185.1 | 35.6 | 8.3 | 36.4 | 11.7 | 63.9 | 12.1 |
| AD-1136186.1 | 40.0 | 14.4 | 35.5 | 13.1 | 49.2 | 8.6 |
| AD-1136187.1 | 28.6 | 2.8 | 29.7 | 11.3 | 34.5 | 9.3 |
| AD-1136188.1 | 42.9 | 6.3 | 53.5 | 11.6 | 74.4 | 49.5 |
| AD-1136189.1 | 42.1 | 7.5 | 27.5 | 6.4 | 82.1 | 4.1 |
| AD-1136190.1 | 52.0 | 21.2 | 51.7 | 20.4 | 102.1 | 6.2 |
| AD-1136191.1 | 34.8 | 5.6 | 42.0 | 17.6 | 51.1 | 10.0 |
| AD-1136192.1 | 53.3 | 7.0 | 47.9 | 12.6 | 62.1 | 3.1 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1136193.1 | 44.7 | 6.5 | 46.9 | 5.6 | 44.0 | 8.3 |
| AD-1136194.1 | 41.4 | 5.9 | 58.6 | 17.5 | 60.4 | 16.8 |
| AD-1136195.1 | 55.5 | 6.3 | 47.9 | 19.4 | 58.2 | 14.3 |
| AD-1136196.1 | 37.3 | 4.0 | 45.8 | 11.9 | 47.8 | 11.2 |
| AD-1136197.1 | 39.2 | 7.4 | 40.0 | 12.2 | 71.4 | 25.0 |
| AD-1136198.1 | 68.5 | 16.0 | 78.5 | 25.7 | 91.1 | 11.8 |
| AD-1136199.1 | 55.3 | 5.4 | 93.1 | 18.1 | 71.0 | 21.0 |
| AD-1136200.1 | 70.6 | 4.0 | 89.1 | 9.9 | 75.5 | 23.2 |
| AD-1136201.1 | 57.1 | 10.4 | 76.0 | 12.2 | 88.0 | 13.0 |
| AD-1136202.1 | 69.9 | 15.3 | 68.6 | 6.4 | 53.2 | 11.9 |
| AD-1136203.1 | 57.4 | 8.3 | 103.7 | 29.4 | 44.9 | 4.9 |
| AD-1136204.1 | 38.2 | 7.2 | 55.3 | 8.9 | 104.7 | 41.6 |
| AD-1136205.1 | 47.9 | 5.5 | 88.6 | 26.9 | 111.5 | 23.5 |
| AD-1136206.1 | 81.7 | 13.0 | 109.4 | 16.9 | 107.2 | 13.7 |
| AD-1136207.1 | 68.2 | 7.2 | 101.3 | 10.3 | 78.6 | 14.3 |
| AD-1136208.1 | 71.8 | 4.9 | 102.4 | 18.6 | 76.5 | 33.1 |
| AD-1136209.1 | 74.7 | 10.1 | 100.9 | 37.2 | 65.8 | 17.0 |
| AD-1136210.1 | 56.3 | 2.9 | 73.5 | 19.8 | 57.7 | 10.7 |
| AD-1136211.1 | 65.2 | 7.3 | 100.2 | 28.2 | 56.4 | 4.2 |
| AD-1136212.1 | 68.0 | 9.0 | 80.4 | 27.1 | 95.4 | 30.6 |
| AD-1136213.1 | 61.3 | 11.2 | 83.6 | 7.5 | 87.1 | 11.6 |
| AD-1136214.1 | 42.3 | 7.1 | 64.9 | 10.9 | 67.7 | 12.0 |
| AD-1136215.1 | 52.8 | 3.6 | 65.0 | 6.1 | 55.1 | 16.4 |
| AD-1136216.1 | 69.3 | 8.4 | 97.1 | 12.4 | 77.4 | 15.7 |
| AD-1136217.1 | 53.8 | 6.9 | 87.4 | 22.9 | 81.9 | 20.1 |
| AD-1136218.1 | 54.8 | 7.2 | 71.0 | 21.4 | 66.1 | 9.4 |
| AD-1136219.1 | 46.9 | 10.2 | 67.7 | 26.7 | 44.6 | 4.5 |
| AD-1136220.1 | 53.5 | 18.0 | 53.3 | 17.1 | 71.6 | 48.4 |
| AD-1136221.1 | 33.1 | 2.5 | 61.5 | 2.1 | 82.6 | 28.7 |
| AD-1136222.1 | 79.1 | 6.2 | 88.6 | 8.3 | 65.8 | 16.5 |
| AD-1136223.1 | 47.6 | 1.8 | 68.0 | 6.1 | 58.6 | 12.7 |
| AD-1136224.1 | 40.2 | 4.4 | 63.3 | 7.5 | 50.3 | 16.6 |
| AD-1136225.1 | 29.8 | 4.6 | 53.7 | 10.7 | 61.3 | 44.7 |
| AD-1136226.1 | 46.1 | 5.2 | 68.0 | 23.6 | 63.3 | 23.9 |
| AD-1136227.1 | 40.9 | 3.9 | 63.0 | 10.2 | 73.8 | 19.3 |
| AD-1136228.1 | 51.9 | 4.9 | 96.7 | 7.6 | 87.7 | 22.9 |
| AD-1136229.1 | 44.5 | 4.0 | 74.2 | 3.7 | 72.2 | 22.1 |
| AD-1136230.1 | 47.2 | 10.2 | 59.5 | 3.9 | 61.6 | 14.2 |
| AD-1136231.1 | 41.2 | 4.9 | 61.0 | 13.5 | 59.6 | 20.1 |
| AD-1136232.1 | 38.2 | 3.0 | 54.9 | 10.1 | 47.9 | 7.5 |
| AD-1136233.1 | 37.2 | 3.9 | 63.7 | 12.1 | 52.9 | 12.6 |
| AD-1136234.1 | 41.4 | 6.6 | 48.2 | 6.9 | 81.9 | 30.6 |
| AD-1136235.1 | 87.4 | 19.0 | 80.6 | 22.0 | 119.7 | 40.0 |
| AD-1136236.1 | 64.4 | 12.3 | 81.2 | 7.2 | 85.9 | 35.2 |
| AD-1136237.1 | 80.5 | 4.3 | 125.8 | 18.4 | 97.4 | 21.2 |
| AD-1136238.1 | 72.1 | 9.4 | 85.2 | 13.8 | 136.5 | 56.4 |
| AD-1136239.1 | 63.0 | 18.5 | 96.0 | 28.1 | 103.5 | 37.2 |
| AD-1136240.1 | 45.1 | 5.4 | 70.7 | 10.4 | 54.5 | 15.1 |
| AD-1136241.1 | 56.8 | 3.7 | 72.3 | 32.0 | 56.3 | 14.8 |
| AD-1136242.1 | 40.6 | 11.9 | 63.1 | 28.3 | 88.7 | 39.4 |
| AD-1136243.1 | 30.8 | 4.4 | 51.7 | 10.8 | 65.4 | 29.0 |
| AD-1136244.1 | 63.3 | 2.2 | 90.1 | 36.7 | 95.2 | 36.8 |
| AD-1136245.1 | 94.6 | 13.8 | 91.9 | 26.1 | 116.1 | 27.6 |
| AD-1136246.1 | 70.0 | 3.9 | 76.0 | 20.1 | 73.2 | 13.3 |
| AD-1136247.1 | 45.3 | 7.2 | 46.7 | 16.3 | 70.7 | 51.5 |
| AD-1136248.1 | 63.1 | 4.0 | 73.3 | 19.8 | 57.4 | 23.2 |
| AD-1136249.1 | 59.2 | 14.4 | 59.4 | 6.1 | 81.5 | 11.1 |
| AD-1136250.1 | 64.4 | 13.2 | 67.4 | 9.5 | 95.8 | 4.8 |
| AD-1136251.1 | 87.5 | 17.7 | 63.5 | 11.6 | 97.1 | 17.0 |
| AD-1136252.1 | 60.1 | 7.2 | 63.5 | 7.9 | 88.6 | 27.3 |
| AD-1136253.1 | 75.8 | 10.0 | 84.2 | 13.3 | 95.7 | 37.6 |
| AD-1136254.1 | 64.6 | 11.0 | 59.6 | 7.9 | 91.7 | 9.5 |
| AD-1136255.1 | 56.8 | 7.8 | 70.0 | 22.1 | 97.7 | 19.5 |
| AD-1136256.1 | 24.7 | 2.9 | 38.0 | 4.3 | 88.3 | 24.6 |
| AD-1136257.1 | 54.9 | 10.8 | 46.2 | 6.8 | 68.8 | 7.2 |
| AD-1136258.1 | 71.1 | 4.1 | 64.2 | 8.4 | 95.1 | 11.8 |
| AD-1136259.1 | 85.2 | 13.4 | 69.2 | 3.5 | 106.0 | 23.0 |
| AD-1136260.1 | 59.0 | 9.7 | 60.9 | 7.5 | 95.2 | 21.8 |
| AD-1136261.1 | 70.1 | 19.7 | 63.3 | 1.9 | 122.1 | 31.3 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1136262.1 | 68.1 | 9.8 | 67.6 | 4.5 | 105.6 | 11.9 |
| AD-1136263.1 | 39.0 | 9.5 | 46.6 | 8.0 | 97.1 | 20.0 |
| AD-1136264.1 | 26.3 | 2.8 | 37.6 | 9.3 | 72.9 | 19.0 |
| AD-1136265.1 | 53.2 | 6.5 | 50.2 | 7.8 | 77.0 | 8.4 |
| AD-1136266.1 | 79.7 | 14.9 | 65.4 | 9.1 | 99.3 | 7.4 |
| AD-1136267.1 | 100.0 | 13.4 | 81.8 | 4.3 | 98.6 | 9.9 |
| AD-1136268.1 | 54.4 | 4.0 | 55.7 | 7.5 | 91.8 | 23.7 |
| AD-1136269.1 | 32.0 | 8.1 | 40.6 | 8.0 | 90.8 | 20.1 |
| AD-1136270.1 | 37.5 | 10.0 | 50.7 | 16.5 | 81.7 | 19.1 |
| AD-1136271.1 | 32.3 | 8.5 | 42.5 | 8.3 | 60.6 | 11.8 |
| AD-1136272.1 | 57.7 | 6.4 | 67.2 | 9.9 | 78.6 | 6.4 |
| AD-1136273.1 | 87.8 | 21.5 | 95.4 | 16.5 | 103.5 | 17.7 |
| AD-1136274.1 | 80.1 | 9.4 | 69.6 | 7.3 | 119.3 | 16.5 |
| AD-1136275.1 | 71.4 | 12.2 | 76.8 | 14.1 | 139.8 | 50.5 |
| AD-1136276.1 | 61.3 | 18.8 | 63.9 | 11.2 | 91.0 | 15.3 |
| AD-1136277.1 | 41.7 | 2.0 | 43.6 | 10.3 | 92.3 | 11.5 |
| AD-1136278.1 | 30.2 | 5.0 | 45.4 | 5.2 | 77.8 | 6.3 |
| AD-1136279.1 | 52.3 | 0.2 | 49.2 | 9.6 | 80.5 | 12.8 |
| AD-1136280.1 | 65.8 | 6.6 | 62.5 | 5.6 | 90.5 | 16.8 |
| AD-1136281.1 | 70.3 | 4.6 | 68.3 | 3.8 | 124.4 | 52.7 |
| AD-1136282.1 | 64.0 | 9.5 | 55.3 | 5.9 | 94.2 | 2.1 |
| AD-1136283.1 | 58.9 | 14.2 | 62.4 | 6.3 | 103.8 | 7.2 |
| AD-1136284.1 | 53.3 | 7.0 | 79.0 | 14.2 | 148.3 | 31.4 |
| AD-1136285.1 | 48.7 | 4.5 | 53.6 | 7.0 | 93.2 | 15.7 |
| AD-1136286.1 | 29.4 | 1.9 | 50.9 | 11.8 | 58.6 | 6.9 |
| AD-1136287.1 | 57.6 | 14.7 | 52.6 | 6.2 | 63.6 | 9.9 |
| AD-1136288.1 | 96.4 | 35.9 | 74.5 | 7.6 | 98.4 | 13.6 |
| AD-1136289.1 | 66.2 | 10.5 | 69.8 | 12.1 | 110.1 | 12.8 |
| AD-1136290.1 | 59.7 | 19.2 | 54.8 | 3.9 | 108.6 | 10.5 |
| AD-1136291.1 | 57.5 | 11.2 | 56.6 | 8.5 | 85.8 | 5.4 |
| AD-1136292.1 | 57.3 | 6.2 | 59.8 | 6.7 | 109.5 | 9.9 |
| AD-1136293.1 | 66.8 | 6.3 | 55.7 | 7.6 | 90.5 | 24.6 |
| AD-1136294.1 | 86.8 | 11.5 | 68.2 | 4.1 | 103.1 | 15.7 |
| AD-1136295.1 | 83.1 | 6.9 | 84.9 | 6.3 | 103.9 | 18.6 |
| AD-1136296.1 | 90.8 | 8.5 | 67.7 | 5.9 | 124.8 | 20.9 |
| AD-1136297.1 | 86.0 | 13.8 | 91.8 | 16.6 | 132.2 | 29.3 |
| AD-1136298.1 | 116.6 | 18.2 | 73.3 | 8.6 | 140.8 | 57.1 |
| AD-1136299.1 | 84.6 | 12.3 | 70.7 | 14.7 | 100.7 | 27.4 |
| AD-1136300.1 | 78.1 | 12.2 | 73.0 | 17.7 | 111.8 | 27.6 |
| AD-1136301.1 | 58.9 | 3.1 | 64.4 | 7.4 | 76.3 | 6.0 |
| AD-1136302.1 | 72.2 | 12.6 | 76.2 | 16.9 | 111.1 | 24.3 |
| AD-1136303.1 | 91.1 | 11.6 | 99.4 | 17.6 | 130.4 | 26.5 |
| AD-1136304.1 | 113.3 | 17.8 | 90.2 | 16.8 | 129.1 | 22.4 |
| AD-1136305.1 | 129.1 | 31.2 | 98.9 | 7.3 | 132.2 | 19.6 |
| AD-1136306.1 | 114.5 | 12.4 | 91.2 | 5.5 | 115.6 | 8.2 |
| AD-1136307.1 | 102.8 | 22.0 | 91.1 | 9.2 | 132.4 | 22.8 |
| AD-1136308.1 | 53.3 | 7.5 | 55.0 | 7.1 | 65.8 | 12.9 |
| AD-1136309.1 | 31.8 | 3.9 | 51.1 | 4.8 | 55.0 | 13.3 |
| AD-1136310.1 | 77.5 | 10.6 | 55.6 | 8.8 | 79.3 | 14.8 |
| AD-1136311.1 | 79.4 | 13.0 | 73.2 | 4.2 | 95.4 | 19.9 |
| AD-1136312.1 | 93.1 | 9.0 | 75.6 | 15.4 | 102.9 | 20.8 |
| AD-1136313.1 | 63.2 | 5.1 | 53.8 | 4.0 | 103.8 | 33.1 |
| AD-1136314.1 | 62.9 | 7.5 | 54.4 | 7.4 | 67.1 | 13.3 |
| AD-1136315.1 | 60.1 | 7.5 | 59.3 | 10.2 | 90.7 | 46.5 |
| AD-1136316.1 | 39.6 | 8.1 | 56.6 | 9.3 | 81.4 | 8.6 |
| AD-1136317.1 | 77.6 | 28.1 | 55.9 | 9.6 | 61.6 | 10.0 |
| AD-1136318.1 | 73.8 | 12.7 | 58.3 | 4.1 | 98.9 | 37.1 |
| AD-1136319.1 | 76.7 | 7.6 | 61.5 | 2.8 | 112.7 | 15.4 |
| AD-1136320.1 | 80.1 | 23.9 | 61.2 | 6.0 | 109.4 | 18.5 |
| AD-1136321.1 | 56.6 | 3.5 | 45.1 | 10.5 | 72.2 | 8.3 |
| AD-1136322.1 | 63.0 | 11.0 | 44.2 | 11.9 | 71.4 | 9.7 |
| AD-1136323.1 | 55.4 | 6.9 | 58.5 | 9.1 | 82.9 | 33.3 |
| AD-1136324.1 | 53.8 | 12.8 | 55.5 | 17.5 | 59.5 | 18.1 |
| AD-1136325.1 | 71.9 | 2.9 | 70.4 | 9.6 | 70.8 | 14.0 |
| AD-1136326.1 | 64.3 | 5.6 | 59.0 | 11.8 | 63.3 | 18.4 |
| AD-1136327.1 | 124.1 | 12.1 | 78.0 | 8.7 | 82.4 | 18.6 |
| AD-1136328.1 | 68.2 | 15.9 | 57.0 | 7.0 | 74.3 | 2.4 |
| AD-1136329.1 | 63.1 | 1.4 | 42.8 | 4.8 | 65.1 | 17.1 |
| AD-1136330.1 | 81.2 | 11.6 | 58.3 | 15.0 | 59.9 | 8.6 |

TABLE 4-continued

Xanthine Dehydrogenase dsRNA Agent In Vitro Single Dose Screens in Primary Human Hepatocytes

| | PHH | | | | | |
|---|---|---|---|---|---|---|
| | 500 nM | | 100 nM | | 10 nM | |
| Duplex ID | % of Avg Message Remaining | STDEV | % of Avg Message Remaining | STDEV | % of Avg Message Remaining | STDEV |
| AD-1136331.1 | 67.7 | 12.3 | 56.1 | 17.5 | 48.3 | 2.3 |
| AD-1136332.1 | 77.2 | 11.5 | 61.1 | 8.7 | 60.2 | 43.9 |
| AD-1136333.1 | 67.6 | 8.3 | 46.4 | 9.6 | 63.5 | 13.5 |
| AD-1136334.1 | 54.7 | 4.7 | 47.0 | 6.7 | 49.5 | 19.6 |
| AD-1136335.1 | 70.7 | 23.3 | 55.9 | 7.3 | 72.2 | 6.0 |
| AD-1136336.1 | 61.4 | 16.0 | 47.3 | 9.7 | 48.6 | 3.0 |
| AD-1136337.1 | 68.7 | 11.8 | 58.5 | 16.7 | 57.7 | 8.7 |
| AD-1136338.1 | 78.3 | 18.3 | 57.4 | 13.1 | 64.1 | 15.3 |

TABLE 5

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1135979.1 | 138.0 | 20.2 | 110.0 | 11.0 | 94.0 | 82.2 | 113.3 | 10.0 |
| AD-1135980.1 | 60.3 | 11.1 | 124.1 | 15.0 | 152.1 | 57.1 | 124.6 | 23.3 |
| AD-1135981.1 | 115.1 | 33.6 | 112.6 | 19.9 | 173.7 | 5.1 | 132.5 | 6.6 |
| AD-1135982.1 | 100.6 | 20.8 | 140.8 | 25.5 | 119.8 | 74.8 | 146.2 | 17.9 |
| AD-1135983.1 | 103.9 | 29.8 | 138.0 | 20.5 | 181.2 | 36.9 | 116.5 | 27.6 |
| AD-1135984.1 | 104.4 | 31.9 | 138.2 | 33.1 | 93.9 | 74.7 | 105.6 | 4.1 |
| AD-1135985.1 | 72.3 | 0.4 | 149.0 | 11.5 | 131.7 | 32.2 | 92.2 | 9.0 |
| AD-1135986.1 | 101.6 | 34.7 | 122.8 | 34.9 | 160.1 | 42.9 | 107.8 | 2.1 |
| AD-1135987.1 | 77.8 | 7.0 | 99.5 | 37.7 | 102.4 | 24.9 | 96.8 | 1.4 |
| AD-1135988.1 | 107.4 | 22.1 | 141.2 | 40.1 | 118.1 | 22.1 | 103.6 | 7.9 |
| AD-1135989.1 | 76.6 | 28.0 | 154.9 | 44.7 | 134.2 | 15.6 | 117.2 | 30.5 |
| AD-1135990.1 | 110.7 | 26.7 | 115.4 | 32.1 | 172.5 | 27.7 | 118.0 | 18.5 |
| AD-1135991.1 | 89.0 | 18.5 | 117.4 | 40.9 | 118.0 | 37.5 | 109.0 | 28.3 |
| AD-1135992.1 | 82.2 | 22.3 | 132.5 | 15.0 | 131.4 | 17.8 | 113.9 | 8.5 |
| AD-1135993.1 | 84.9 | 17.3 | 137.0 | 22.9 | 107.0 | 18.4 | 112.8 | 6.2 |
| AD-1135994.1 | 94.1 | 3.2 | 101.9 | 23.4 | 124.7 | 25.3 | 109.1 | 24.7 |
| AD-1135995.1 | 93.4 | 21.3 | 111.5 | 28.2 | 120.0 | 14.0 | 87.7 | 12.5 |
| AD-1135996.1 | 85.0 | 6.0 | 157.7 | 64.6 | 142.4 | 17.5 | 134.1 | 30.0 |
| AD-1135997.1 | 67.4 | 6.9 | 117.1 | 35.1 | 128.1 | 33.4 | 125.0 | 20.4 |
| AD-1135998.1 | 77.2 | 11.3 | 131.9 | 62.5 | 99.5 | 27.0 | 111.0 | 19.9 |
| AD-1135999.1 | 75.6 | 11.2 | 94.3 | 4.3 | 102.1 | 20.1 | 103.1 | 23.0 |
| AD-1136000.1 | 82.0 | 11.1 | 125.5 | 37.5 | 106.1 | 13.5 | 118.5 | 14.2 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136001.1 | 59.7 | 5.8 | 103.7 | 32.6 | 94.7 | 38.1 | 110.8 | 2.2 |
| AD-1136002.1 | 60.2 | 4.1 | 92.6 | 20.9 | 127.4 | 14.7 | 96.5 | 14.6 |
| AD-1136003.1 | 66.1 | 8.7 | 102.6 | 31.8 | 116.8 | 15.5 | 124.7 | 18.1 |
| AD-1136004.1 | 77.0 | 18.8 | 85.8 | 32.3 | 134.9 | 22.7 | 140.4 | 22.5 |
| AD-1136005.1 | 88.5 | 10.2 | 86.9 | 41.1 | 113.1 | 28.5 | 101.3 | 29.5 |
| AD-1136006.1 | 83.2 | 2.1 | 99.4 | 40.8 | 89.2 | 11.1 | 95.8 | 7.1 |
| AD-1136007.1 | 56.8 | 16.1 | 116.8 | 44.8 | 121.3 | 23.8 | 103.6 | 13.2 |
| AD-1136008.1 | 79.6 | 17.1 | 93.4 | 27.4 | 155.3 | 32.6 | 81.5 | 25.5 |
| AD-1136009.1 | 65.8 | 4.8 | 95.4 | 34.1 | 156.8 | 25.5 | 101.6 | 15.2 |
| AD-1136010.1 | 87.1 | 18.6 | 81.0 | 24.9 | 94.1 | 34.9 | 109.8 | 12.7 |
| AD-1136011.1 | 82.3 | 5.7 | 93.9 | 40.1 | 94.0 | 19.6 | 130.1 | 19.9 |
| AD-1136012.1 | 71.5 | 14.2 | 114.2 | 12.5 | 116.8 | 38.3 | 124.7 | 9.9 |
| AD-1136013.1 | 68.9 | 8.8 | 129.5 | 46.1 | 91.6 | 6.2 | 119.2 | 9.8 |
| AD-1136014.1 | 73.4 | 10.5 | 68.6 | 10.6 | 106.6 | 56.2 | 104.1 | 7.0 |
| AD-1136015.1 | 71.8 | 4.9 | 90.5 | 16.0 | 98.2 | 41.2 | 101.7 | 16.1 |
| AD-1136016.1 | 78.6 | 5.7 | 82.7 | 10.9 | 130.1 | 140.2 | 120.4 | 4.7 |
| AD-1136017.1 | 59.2 | 6.3 | 83.5 | 24.7 | 82.3 | 56.2 | 81.9 | 1.2 |
| AD-1136018.1 | 57.7 | 12.0 | 64.2 | 19.9 | 105.4 | 11.3 | 98.8 | 22.8 |
| AD-1136019.1 | 67.2 | 10.5 | 93.1 | 25.7 | 102.7 | 15.4 | 107.9 | 10.1 |
| AD-1136020.1 | 75.4 | 19.4 | 87.3 | 38.5 | 101.6 | 22.5 | 126.2 | 13.2 |
| AD-1136021.1 | 61.3 | 3.6 | 65.8 | 6.1 | 77.1 | 14.4 | 113.4 | 17.8 |
| AD-1136022.1 | 59.2 | 22.6 | 75.0 | 13.3 | 116.4 | 48.4 | 107.3 | 17.4 |
| AD-1136023.1 | 71.9 | 21.4 | 76.1 | 14.2 | 100.8 | 38.3 | 91.6 | 16.3 |
| AD-1136024.1 | 82.1 | 8.1 | 81.4 | 35.1 | 116.6 | 5.3 | 83.7 | 4.5 |
| AD-1136025.1 | 75.8 | 30.1 | 107.4 | 32.7 | 115.5 | 5.3 | 87.4 | 15.6 |
| AD-1136026.1 | 69.2 | 11.6 | 127.8 | 46.6 | 97.5 | 24.8 | 95.5 | 18.1 |
| AD-1136027.1 | 86.9 | 8.3 | 118.5 | 19.4 | 124.4 | 28.7 | 116.4 | 24.3 |
| AD-1136028.1 | 84.2 | 30.1 | 139.7 | 31.6 | 95.7 | 7.5 | 125.4 | 18.6 |
| AD-1136029.1 | 75.1 | 8.4 | 82.5 | 19.0 | 74.3 | 8.3 | 93.3 | 12.2 |
| AD-1136030.1 | 44.5 | 5.6 | 84.2 | 33.7 | 120.3 | 51.2 | 99.0 | 14.8 |
| AD-1136031.1 | 66.2 | 9.8 | 96.0 | 46.4 | 117.0 | 67.0 | 80.8 | 16.5 |
| AD-1136032.1 | 62.1 | 16.0 | 65.9 | 13.8 | 91.3 | 60.9 | 82.6 | 11.3 |
| AD-1136033.1 | 61.5 | 7.8 | 83.1 | 16.5 | 123.6 | 23.4 | 102.5 | 17.5 |
| AD-1136034.1 | 54.3 | 16.6 | 80.6 | 13.2 | 101.9 | 7.7 | 105.9 | 6.3 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136035.1 | 78.6 | 19.3 | 93.1 | 20.7 | 112.6 | 15.2 | 117.2 | 4.8 |
| AD-1136036.1 | 79.4 | 5.2 | 77.1 | 19.8 | 159.8 | 86.1 | 105.2 | 23.1 |
| AD-1136037.1 | 59.5 | 16.2 | 89.9 | 32.7 | 71.5 | 11.2 | 100.6 | 3.3 |
| AD-1136038.1 | 56.9 | 11.1 | 68.5 | 10.1 | 98.6 | 41.5 | 95.9 | 15.9 |
| AD-1136039.1 | 49.4 | 7.2 | 61.8 | 25.1 | 153.5 | 77.6 | 74.7 | 13.8 |
| AD-1136040.1 | 52.1 | 13.1 | 84.6 | 35.1 | 155.3 | 9.7 | 72.5 | 7.5 |
| AD-1136041.1 | 71.9 | 17.8 | 75.0 | 29.6 | 89.4 | 10.9 | 91.1 | 9.1 |
| AD-1136042.1 | 85.2 | 25.0 | 76.0 | 6.6 | 120.5 | 23.3 | 113.6 | 14.8 |
| AD-1136043.1 | 89.3 | 21.7 | 89.1 | 45.3 | 110.0 | 4.8 | 92.9 | 23.7 |
| AD-1136044.1 | 81.6 | 16.4 | 66.5 | 15.2 | 101.0 | 38.9 | 92.7 | 23.4 |
| AD-1136045.1 | 68.2 | 3.6 | 75.1 | 13.4 | 84.4 | 22.8 | 92.8 | 12.6 |
| AD-1136046.1 | 75.8 | 7.4 | 90.3 | 25.3 | 71.8 | 12.2 | 71.5 | 3.7 |
| AD-1136047.1 | 94.8 | 5.1 | 98.7 | 40.9 | 134.8 | 25.3 | 70.6 | 2.4 |
| AD-1136048.1 | 78.6 | 18.3 | 84.4 | 22.1 | 92.4 | 15.9 | 71.7 | 4.1 |
| AD-1136049.1 | 91.4 | 32.0 | 84.3 | 19.5 | 111.3 | 17.6 | 113.8 | 13.0 |
| AD-1136050.1 | 64.1 | 15.1 | 89.4 | 27.9 | 101.3 | 45.3 | 97.5 | 23.8 |
| AD-1136051.1 | 44.3 | 7.4 | 67.5 | 28.3 | 86.1 | 18.7 | 107.4 | 25.9 |
| AD-1136052.1 | 62.3 | 17.5 | 69.8 | 32.2 | 86.2 | 19.2 | 77.4 | 21.0 |
| AD-1136053.1 | 57.0 | 5.6 | 77.8 | 20.7 | 131.4 | 35.3 | 68.9 | 22.1 |
| AD-1136054.1 | 59.2 | 17.7 | 75.6 | 21.8 | 97.2 | 26.8 | 80.9 | 6.7 |
| AD-1136055.1 | 74.7 | 13.5 | 94.8 | 20.5 | 74.2 | 19.1 | 88.6 | 11.4 |
| AD-1136056.1 | 70.8 | 19.5 | 85.1 | 20.8 | 117.7 | 26.0 | 92.1 | 4.1 |
| AD-1136057.1 | 78.2 | 3.3 | 125.3 | 24.0 | 127.3 | 31.9 | 93.4 | 12.6 |
| AD-1136058.1 | 73.7 | 15.3 | 64.5 | 13.5 | 113.2 | 21.3 | 81.7 | 23.1 |
| AD-1136059.1 | 84.5 | 9.5 | 90.3 | 28.2 | 118.2 | 61.6 | 81.6 | 15.8 |
| AD-1136060.1 | 72.5 | 14.4 | 70.5 | 22.8 | 80.7 | 13.0 | 65.1 | 14.1 |
| AD-1136061.1 | 60.8 | 20.7 | 84.8 | 15.8 | 99.7 | 27.0 | 54.9 | 1.6 |
| AD-1136062.1 | 96.7 | 25.3 | 60.3 | 2.9 | 75.1 | 18.2 | 56.1 | 29.9 |
| AD-1136063.1 | 87.6 | 7.4 | 63.4 | 14.6 | 72.7 | 15.4 | 69.6 | 9.6 |
| AD-1136064.1 | 77.7 | 11.2 | 91.6 | 7.0 | 152.9 | 110.5 | 99.5 | 32.0 |
| AD-1136065.1 | 64.0 | 13.4 | 80.7 | 20.6 | 81.6 | 22.8 | 72.8 | 5.9 |
| AD-1136066.1 | 45.0 | 9.3 | 93.1 | 22.7 | 91.3 | 24.0 | 74.5 | 11.0 |
| AD-1136067.1 | 82.1 | 15.8 | 71.3 | 9.4 | 111.2 | 40.5 | 65.7 | 7.6 |
| AD-1136068.1 | 59.5 | 7.1 | 65.8 | 7.8 | 46.3 | 3.4 | 59.5 | 9.9 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136069.1 | 70.5 | 11.2 | 110.1 | 34.4 | 93.5 | 9.2 | 116.6 | 15.6 |
| AD-1136070.1 | 72.7 | 14.9 | 97.8 | 10.1 | 123.2 | 9.0 | 119.7 | 19.3 |
| AD-1136071.1 | 89.3 | 29.7 | 147.2 | 32.6 | 116.4 | 9.6 | 120.2 | 22.4 |
| AD-1136072.1 | 95.5 | 10.2 | 119.5 | 39.2 | 126.8 | 29.4 | 122.5 | 5.6 |
| AD-1136073.1 | 87.5 | 9.9 | 109.6 | 20.4 | 129.3 | 13.0 | 129.0 | 17.8 |
| AD-1136074.1 | 79.1 | 16.2 | 120.6 | 3.2 | 109.1 | 10.5 | 130.8 | 13.1 |
| AD-1136075.1 | 82.2 | 18.7 | 96.5 | 22.5 | 105.9 | 9.6 | 126.9 | 18.4 |
| AD-1136076.1 | 91.2 | 18.0 | 85.6 | 27.6 | 85.6 | 12.4 | 110.3 | 23.2 |
| AD-1136077.1 | 74.5 | 16.0 | 99.0 | 10.9 | 104.5 | 14.7 | 104.4 | 13.8 |
| AD-1136078.1 | 100.1 | 9.6 | 130.6 | 11.9 | 113.5 | 15.7 | 135.4 | 21.0 |
| AD-1136079.1 | 101.0 | 14.8 | 143.2 | 10.1 | 127.3 | 15.3 | 140.5 | 24.4 |
| AD-1136080.1 | 96.1 | 19.2 | 146.9 | 13.4 | 135.5 | 16.3 | 117.8 | 19.4 |
| AD-1136081.1 | 83.7 | 28.2 | 82.3 | 18.0 | 115.2 | 19.9 | 106.3 | 10.7 |
| AD-1136082.1 | 72.0 | 11.5 | 97.0 | 19.0 | 94.7 | 23.0 | 101.9 | 10.1 |
| AD-1136083.1 | 69.3 | 10.0 | 115.8 | 28.1 | 101.8 | 10.0 | 113.2 | 9.7 |
| AD-1136084.1 | 81.1 | 10.4 | 94.1 | 15.0 | 85.7 | 4.8 | 120.1 | 29.3 |
| AD-1136085.1 | 85.9 | 15.2 | 118.5 | 28.7 | 96.3 | 12.8 | 107.9 | 6.7 |
| AD-1136086.1 | 83.1 | 19.4 | 129.9 | 14.1 | 141.3 | 1.7 | 119.5 | 25.6 |
| AD-1136087.1 | 100.3 | 8.6 | 137.9 | 31.5 | 118.5 | 23.2 | 105.9 | 21.7 |
| AD-1136088.1 | 97.3 | 20.8 | 140.1 | 6.0 | 113.2 | 25.0 | 95.9 | 7.5 |
| AD-1136089.1 | 98.5 | 16.6 | 121.8 | 27.9 | 101.3 | 13.0 | 94.3 | 31.5 |
| AD-1136090.1 | 106.2 | 20.8 | 140.4 | 15.5 | 101.2 | 11.2 | 99.1 | 9.0 |
| AD-1136091.1 | 73.4 | 7.7 | 96.1 | 17.9 | 91.4 | 11.8 | 107.2 | 18.0 |
| AD-1136092.1 | 72.0 | 15.5 | 107.6 | 7.0 | 94.3 | 10.6 | 100.8 | 19.5 |
| AD-1136093.1 | 85.7 | 19.5 | 105.7 | 25.1 | 126.6 | 14.6 | 122.6 | 27.1 |
| AD-1136094.1 | 82.4 | 14.4 | 141.4 | 17.8 | 128.2 | 4.1 | 143.9 | 43.9 |
| AD-1136095.1 | 85.0 | 16.7 | 112.5 | 26.9 | 118.6 | 13.7 | 97.8 | 25.1 |
| AD-1136096.1 | 104.5 | 14.0 | 119.3 | 28.0 | 113.7 | 15.1 | 111.6 | 8.6 |
| AD-1136097.1 | 94.4 | 18.7 | 121.0 | 28.7 | 99.6 | 22.6 | 81.0 | 7.2 |
| AD-1136098.1 | 66.1 | 19.4 | 100.5 | 41.4 | 79.1 | 15.3 | 70.6 | 7.3 |
| AD-1136099.1 | 68.3 | 4.4 | 88.1 | 9.5 | 111.4 | 7.6 | 105.9 | 10.8 |
| AD-1136100.1 | 64.9 | 19.9 | 99.2 | 3.7 | 112.4 | 17.2 | 123.6 | 20.1 |
| AD-1136101.1 | 67.7 | 12.8 | 107.3 | 26.3 | 121.3 | 16.0 | 117.7 | 18.2 |
| AD-1136102.1 | 86.3 | 24.3 | 132.6 | 11.5 | 138.2 | 14.7 | 144.2 | 15.2 |

TABLE 5-continued

Xanthine Dehydrogenase dsRNA Agent In Vitro Single Dose Screens in Primary Cynomolgus Hepatocytes

| Duplex ID | PCH | | | | | | | |
|---|---|---|---|---|---|---|---|---|
| | 500 nM | | 100 nM | | 10 nM | | 0.1 nM | |
| | % of Avg Message Remaining | STDEV | % of Avg Message Remaining | STDEV | % of Avg Message Remaining | STDEV | % of Avg Message Remaining | STDEV |
| AD-1136103.1 | 81.7 | 18.6 | 121.1 | 32.7 | 100.0 | 19.9 | 124.6 | 27.2 |
| AD-1136104.1 | 69.6 | 6.9 | 101.7 | 5.5 | 106.3 | 12.3 | 99.0 | 14.6 |
| AD-1136105.1 | 83.9 | 26.6 | 96.0 | 28.4 | 88.3 | 6.1 | 95.9 | 16.0 |
| AD-1136106.1 | 74.4 | 18.2 | 121.1 | 39.6 | 73.2 | 10.2 | 97.2 | 13.7 |
| AD-1136107.1 | 69.3 | 9.2 | 102.7 | 12.1 | 78.9 | 11.3 | 74.4 | 3.5 |
| AD-1136108.1 | 69.5 | 9.8 | 105.9 | 9.3 | 96.8 | 19.0 | 111.2 | 8.6 |
| AD-1136109.1 | 72.8 | 11.1 | 111.8 | 12.9 | 114.2 | 8.7 | 122.4 | 20.9 |
| AD-1136110.1 | 100.8 | 9.3 | 128.7 | 27.3 | 125.8 | 17.6 | 124.7 | 17.2 |
| AD-1136111.1 | 94.8 | 10.0 | 95.0 | 18.0 | 104.9 | 15.7 | 100.7 | 15.9 |
| AD-1136112.1 | 82.1 | 10.6 | 113.0 | 19.4 | 84.3 | 17.3 | 114.3 | 18.2 |
| AD-1136114.1 | 56.6 | 8.9 | 101.7 | 21.4 | 90.1 | 5.0 | 98.0 | 36.5 |
| AD-1136115.1 | 72.9 | 15.9 | 121.0 | 29.4 | 116.4 | 21.1 | 95.7 | 12.5 |
| AD-1136116.1 | 82.9 | 5.1 | 110.2 | 7.2 | 100.3 | 8.4 | 88.8 | 11.4 |
| AD-1136117.1 | 63.2 | 26.4 | 97.7 | 4.8 | 119.2 | 27.4 | 90.4 | 13.0 |
| AD-1136118.1 | 61.6 | 4.3 | 95.5 | 25.6 | 84.9 | 10.6 | 86.1 | 11.7 |
| AD-1136119.1 | 82.1 | 15.1 | 116.6 | 5.7 | 93.1 | 17.2 | 95.9 | 8.6 |
| AD-1136120.1 | 74.9 | 9.7 | 93.3 | 18.1 | 77.3 | 10.4 | 92.8 | 11.7 |
| AD-1136121.1 | 83.0 | 20.0 | 69.1 | 21.8 | 65.5 | 6.7 | 73.5 | 8.7 |
| AD-1136122.1 | 68.4 | 10.0 | 90.0 | 11.9 | 97.5 | 12.8 | 90.8 | 8.0 |
| AD-1136123.1 | 76.3 | 14.8 | 109.2 | 6.3 | 108.2 | 19.9 | 85.4 | 25.2 |
| AD-1136124.1 | 76.1 | 9.4 | 97.8 | 18.2 | 98.9 | 14.5 | 96.9 | 16.9 |
| AD-1136125.1 | 77.7 | 21.2 | 100.9 | 17.9 | 115.5 | 27.9 | 109.8 | 18.2 |
| AD-1136126.1 | 91.7 | 16.1 | 92.7 | 13.9 | 104.3 | 27.1 | 101.7 | 11.3 |
| AD-1136127.1 | 58.6 | 8.7 | 82.4 | 24.5 | 88.4 | 17.5 | 83.0 | 11.3 |
| AD-1136128.1 | 76.2 | 22.3 | 99.3 | 18.3 | 92.0 | 9.4 | 81.3 | 13.0 |
| AD-1136129.1 | 68.2 | 14.1 | 68.7 | 22.7 | 71.5 | 17.4 | 66.4 | 15.3 |
| AD-1136130.1 | 80.8 | 13.1 | 97.9 | 6.2 | 97.0 | 11.2 | 76.9 | 7.8 |
| AD-1136131.1 | 76.6 | 19.3 | 113.4 | 2.7 | 103.2 | 26.0 | 89.0 | 8.9 |
| AD-1136132.1 | 78.2 | 9.9 | 123.5 | 16.4 | 132.2 | 21.3 | 110.4 | 19.0 |
| AD-1136133.1 | 84.8 | 19.3 | 87.9 | 18.4 | 108.8 | 23.8 | 101.2 | 7.4 |
| AD-1136134.1 | 79.4 | 5.0 | 94.6 | 5.1 | 96.5 | 15.0 | 110.6 | 21.3 |
| AD-1136135.1 | 87.2 | 14.7 | 75.4 | 25.0 | 90.2 | 11.1 | 79.6 | 25.2 |
| AD-1136136.1 | 65.1 | 6.8 | 55.1 | 31.4 | 69.7 | 12.2 | 63.4 | 15.5 |
| AD-1136137.1 | 83.6 | 9.9 | 107.0 | 0.5 | 102.7 | 17.4 | 96.2 | 6.1 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136138.1 | 59.1 | 7.9 | 116.3 | 22.9 | 92.4 | 6.3 | 110.3 | 12.6 |
| AD-1136139.1 | 80.1 | 7.5 | 102.2 | 15.4 | 123.0 | 15.0 | 113.0 | 26.8 |
| AD-1136140.1 | 77.9 | 15.8 | 73.4 | 17.7 | 107.6 | 12.2 | 103.5 | 24.3 |
| AD-1136141.1 | 63.5 | 7.4 | 73.2 | 15.7 | 78.5 | 10.8 | 96.1 | 16.1 |
| AD-1136142.1 | 72.4 | 15.8 | 63.2 | 11.8 | 76.8 | 14.6 | 73.9 | 22.0 |
| AD-1136143.1 | 69.1 | 6.8 | 63.6 | 11.9 | 68.0 | 17.8 | 64.6 | 9.4 |
| AD-1136144.1 | 80.1 | 8.4 | 75.1 | 10.5 | 99.9 | 19.3 | 83.1 | 4.2 |
| AD-1136145.1 | 83.3 | 5.0 | 97.0 | 21.2 | 96.8 | 9.8 | 97.4 | 19.6 |
| AD-1136146.1 | 94.1 | 16.7 | 104.8 | 32.0 | 95.2 | 23.4 | 97.1 | 15.9 |
| AD-1136147.1 | 97.9 | 8.6 | 112.2 | 15.3 | 114.9 | 7.5 | 100.2 | 10.3 |
| AD-1136148.1 | 86.8 | 11.6 | 72.8 | 24.6 | 95.8 | 12.9 | 100.1 | 20.1 |
| AD-1136149.1 | 81.9 | 12.9 | 85.2 | 10.2 | 90.9 | 17.0 | 97.5 | 34.3 |
| AD-1136150.1 | 71.1 | 5.3 | 80.7 | 16.4 | 87.1 | 12.8 | 94.7 | 34.4 |
| AD-1136151.1 | 89.7 | 19.7 | 63.0 | 38.6 | 67.7 | 3.9 | 62.1 | 22.2 |
| AD-1136152.1 | 84.8 | 17.6 | 93.9 | 21.0 | 105.4 | 14.2 | 67.3 | 8.3 |
| AD-1136153.1 | 80.9 | 9.8 | 105.6 | 2.5 | 101.6 | 8.9 | 87.8 | 12.2 |
| AD-1136154.1 | 86.4 | 7.8 | 83.5 | 15.1 | 103.4 | 9.4 | 97.1 | 10.3 |
| AD-1136155.1 | 90.9 | 23.6 | 112.1 | 16.9 | 109.5 | 7.9 | 88.2 | 6.4 |
| AD-1136156.1 | 69.2 | 12.9 | 82.9 | 26.6 | 93.4 | 9.8 | 88.3 | 12.9 |
| AD-1136157.1 | 76.5 | 9.5 | 75.5 | 16.4 | 96.3 | 12.5 | 82.6 | 10.7 |
| AD-1136158.1 | 78.1 | 10.3 | 85.5 | 6.5 | 88.7 | 7.4 | 71.2 | 9.2 |
| AD-1136159.1 | 43.3 | 40.2 | 121.4 | 41.6 | 109.5 | 11.3 | 143.7 | 73.3 |
| AD-1136160.1 | 95.8 | 25.4 | 118.1 | 53.7 | 115.4 | 13.3 | 130.2 | 33.1 |
| AD-1136161.1 | 156.0 | 58.2 | 158.0 | 40.7 | 114.7 | 14.2 | 132.5 | 23.9 |
| AD-1136162.1 | 69.3 | 23.9 | 120.9 | 33.9 | 119.8 | 12.2 | 160.5 | 24.0 |
| AD-1136163.1 | 74.1 | 4.3 | 94.9 | 15.8 | 101.1 | 19.6 | 107.3 | 18.3 |
| AD-1136164.1 | 102.0 | 13.5 | 162.8 | 81.5 | 97.7 | 33.3 | 128.5 | 10.1 |
| AD-1136165.1 | 78.9 | 28.8 | 144.5 | 32.9 | 92.1 | 21.7 | 134.9 | 48.1 |
| AD-1136166.1 | 75.5 | 34.6 | 129.8 | 26.6 | 75.9 | 136.2 | 54.8 | |
| AD-1136167.1 | 168.2 | 35.6 | 110.6 | 17.3 | 98.8 | 47.9 | 77.2 | 42.5 |
| AD-1136168.1 | 107.5 | 25.5 | 98.5 | 14.6 | 132.1 | 8.3 | 124.0 | 24.5 |
| AD-1136169.1 | 77.7 | 14.0 | 93.4 | 13.3 | 87.9 | 24.6 | 99.9 | 8.8 |
| AD-1136170.1 | 87.2 | 23.0 | 113.2 | 28.8 | 115.9 | 4.3 | 145.8 | 19.7 |
| AD-1136171.1 | 88.8 | 28.1 | 141.1 | 2.8 | 125.2 | 33.6 | 140.4 | 6.1 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136172.1 | 101.1 | 18.3 | 106.3 | 21.5 | 106.1 | 29.3 | 135.0 | 23.7 |
| AD-1136173.1 | 89.1 | 26.0 | 105.4 | 20.8 | 96.5 | 17.9 | 88.9 | 10.9 |
| AD-1136174.1 | 98.9 | 17.1 | 56.1 | 33.7 | 94.9 | 17.2 | 122.7 | 64.3 |
| AD-1136175.1 | 119.8 | 18.5 | 130.4 | 31.7 | 73.5 | 23.3 | 129.4 | 10.1 |
| AD-1136176.1 | 95.1 | 17.7 | 132.3 | 10.0 | 128.0 | 17.0 | 125.7 | 17.9 |
| AD-1136177.1 | 111.2 | 12.0 | 129.7 | 18.6 | 130.1 | 30.2 | 109.7 | 6.2 |
| AD-1136178.1 | 81.9 | 12.8 | 111.7 | 15.8 | 120.8 | 18.5 | 124.3 | 49.9 |
| AD-1136179.1 | 103.0 | 13.1 | 123.6 | 10.8 | 129.2 | 12.7 | 94.3 | 10.2 |
| AD-1136180.1 | 94.1 | 14.4 | 119.8 | 20.6 | 109.1 | 8.7 | 104.5 | 5.6 |
| AD-1136181.1 | 80.4 | 8.6 | 61.1 | 4.8 | 103.7 | 32.6 | 98.9 | 20.2 |
| AD-1136182.1 | 146.5 | 24.7 | 113.3 | 14.7 | 124.3 | 60.8 | 117.5 | 3.7 |
| AD-1136183.1 | 81.8 | 16.0 | 114.8 | 23.7 | 130.1 | 19.2 | 129.3 | 19.0 |
| AD-1136184.1 | 100.5 | 10.5 | 140.0 | 26.6 | 119.3 | 27.8 | 109.2 | 18.4 |
| AD-1136185.1 | 86.3 | 13.5 | 113.6 | 20.7 | 137.7 | 7.9 | 129.4 | 27.5 |
| AD-1136186.1 | 68.2 | 10.7 | 114.0 | 3.0 | 130.5 | 24.9 | 104.8 | 11.0 |
| AD-1136187.1 | 85.9 | 20.0 | 97.3 | 17.9 | 103.1 | 18.0 | 91.6 | 4.3 |
| AD-1136188.1 | 87.2 | 6.2 | 126.8 | 6.8 | 103.7 | 17.8 | 95.3 | 25.2 |
| AD-1136189.1 | 87.1 | 34.4 | 138.2 | 21.0 | 126.3 | 18.3 | 122.3 | 27.9 |
| AD-1136190.1 | 116.7 | 40.3 | 121.6 | 10.3 | 134.5 | 15.8 | 163.3 | 48.0 |
| AD-1136191.1 | 105.2 | 15.4 | 130.1 | 34.0 | 124.4 | 16.8 | 121.0 | 27.5 |
| AD-1136192.1 | 97.3 | 17.1 | 151.8 | 11.8 | 131.1 | 30.0 | 145.5 | 16.0 |
| AD-1136193.1 | 93.6 | 21.5 | 110.8 | 20.2 | 130.3 | 34.5 | 116.7 | 25.5 |
| AD-1136194.1 | 91.0 | 17.6 | 125.2 | 22.1 | 126.9 | 7.4 | 103.6 | 23.3 |
| AD-1136195.1 | 109.6 | 21.9 | 92.9 | 19.4 | 108.0 | 13.5 | 81.9 | 12.5 |
| AD-1136196.1 | 85.2 | 33.9 | 85.2 | 27.3 | 104.2 | 20.9 | 100.2 | 10.9 |
| AD-1136197.1 | 104.7 | 12.5 | 86.5 | 17.1 | 127.6 | 39.6 | 132.2 | 40.1 |
| AD-1136198.1 | 122.2 | 24.1 | 103.0 | 19.9 | 138.2 | 18.1 | 124.0 | 34.7 |
| AD-1136199.1 | 76.7 | 17.3 | 95.9 | 7.4 | 116.7 | 12.3 | 111.4 | 12.1 |
| AD-1136200.1 | 91.6 | 16.2 | 123.1 | 25.2 | 126.9 | 32.2 | 104.0 | 36.0 |
| AD-1136201.1 | 73.6 | 15.4 | 99.6 | 26.1 | 83.8 | 11.3 | 71.5 | 19.1 |
| AD-1136202.1 | 72.7 | 8.6 | 95.9 | 24.1 | 114.6 | 28.7 | 87.1 | 17.2 |
| AD-1136203.1 | 69.9 | 11.0 | 74.6 | 18.4 | 126.8 | 20.6 | 85.4 | 20.3 |
| AD-1136204.1 | 99.9 | 53.1 | 89.2 | 16.7 | 137.2 | 4.5 | 138.9 | 4.8 |
| AD-1136205.1 | 73.4 | 17.8 | 107.7 | 17.5 | 144.7 | 21.8 | 136.0 | 38.7 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136206.1 | 87.3 | 18.9 | 120.5 | 11.0 | 107.3 | 20.5 | 115.5 | 40.3 |
| AD-1136207.1 | 85.5 | 21.6 | 112.6 | 26.2 | 81.9 | 28.3 | 74.5 | 4.6 |
| AD-1136208.1 | 83.6 | 5.3 | 115.1 | 15.6 | 79.9 | 26.1 | 80.1 | 7.7 |
| AD-1136209.1 | 74.1 | 16.9 | 83.9 | 7.0 | 101.2 | 33.8 | 68.2 | 18.6 |
| AD-1136210.1 | 79.2 | 15.2 | 92.9 | 17.0 | 92.2 | 25.5 | 80.1 | 12.7 |
| AD-1136211.1 | 77.9 | 18.3 | 75.0 | 8.5 | 110.5 | 6.5 | 80.6 | 6.9 |
| AD-1136212.1 | 76.2 | 41.5 | 109.6 | 24.4 | 118.0 | 16.6 | 139.1 | 3.9 |
| AD-1136213.1 | 95.4 | 20.3 | 92.9 | 11.9 | 123.4 | 16.0 | 109.1 | 16.9 |
| AD-1136214.1 | 62.4 | 14.1 | 76.6 | 6.7 | 89.2 | 17.3 | 102.8 | 27.1 |
| AD-1136215.1 | 63.4 | 16.7 | 105.3 | 15.1 | 100.4 | 34.7 | 73.6 | 25.3 |
| AD-1136216.1 | 66.8 | 17.6 | 82.2 | 29.4 | 127.5 | 22.5 | 108.9 | 16.2 |
| AD-1136217.1 | 60.3 | 20.1 | 63.7 | 10.4 | 64.0 | 13.9 | 61.2 | 27.6 |
| AD-1136218.1 | 66.6 | 13.3 | 60.5 | 8.7 | 70.1 | 14.6 | 65.6 | 16.3 |
| AD-1136219.1 | 65.6 | 9.5 | 107.3 | 32.2 | 95.2 | 19.9 | 75.7 | 3.7 |
| AD-1136220.1 | 111.3 | 22.6 | 129.8 | 14.7 | 135.3 | 32.2 | 155.5 | 85.4 |
| AD-1136221.1 | 85.1 | 10.8 | 101.0 | 8.3 | 102.0 | 23.9 | 105.4 | 25.9 |
| AD-1136222.1 | 85.7 | 2.2 | 108.6 | 13.3 | 74.7 | 29.6 | 60.8 | 13.5 |
| AD-1136223.1 | 76.1 | 23.3 | 65.4 | 13.2 | 76.0 | 30.7 | 79.3 | 17.7 |
| AD-1136224.1 | 66.5 | 6.4 | 62.6 | 14.6 | 47.6 | 6.1 | 48.1 | 11.1 |
| AD-1136225.1 | 67.1 | 7.3 | 51.4 | 20.4 | 48.0 | 11.6 | 55.6 | 13.0 |
| AD-1136226.1 | 59.5 | 6.6 | 68.7 | 10.4 | 96.1 | 19.1 | 78.7 | 6.3 |
| AD-1136227.1 | 107.2 | 4.1 | 125.4 | 21.5 | 80.0 | 13.7 | 112.2 | 74.8 |
| AD-1136228.1 | 87.8 | 35.4 | 104.9 | 2.0 | 102.5 | 28.2 | 94.9 | 16.3 |
| AD-1136229.1 | 74.8 | 21.7 | 70.0 | 10.9 | 58.6 | 14.0 | 52.2 | 1.6 |
| AD-1136230.1 | 60.7 | 17.2 | 77.6 | 6.4 | 54.3 | 5.5 | 48.5 | 8.1 |
| AD-1136231.1 | 60.2 | 15.3 | 64.9 | 17.5 | 62.8 | 25.9 | 39.2 | 8.6 |
| AD-1136232.1 | 53.8 | 19.5 | 49.8 | 7.0 | 71.1 | 15.0 | 64.2 | 12.0 |
| AD-1136233.1 | 67.8 | 10.5 | 75.0 | 16.4 | 99.8 | 9.7 | 89.5 | 18.3 |
| AD-1136234.1 | 135.9 | 39.0 | 99.5 | 7.3 | 76.8 | 6.8 | 86.4 | 32.5 |
| AD-1136235.1 | 106.5 | 18.7 | 97.4 | 17.9 | 92.2 | 11.3 | 81.5 | 18.2 |
| AD-1136236.1 | 73.8 | 11.1 | 83.1 | 7.2 | 85.4 | 12.0 | 81.7 | 5.4 |
| AD-1136237.1 | 72.0 | 45.6 | 79.6 | 5.5 | 58.9 | 17.0 | 52.5 | 7.6 |
| AD-1136238.1 | 73.1 | 3.2 | 75.4 | 12.1 | 52.1 | 4.1 | 45.3 | 7.1 |
| AD-1136239.1 | 59.5 | 17.2 | 66.6 | 18.3 | 57.2 | 8.8 | 58.9 | 27.6 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136240.1 | 61.1 | 7.6 | 63.8 | 2.7 | 89.7 | 21.7 | 75.9 | 6.2 |
| AD-1136241.1 | 93.9 | 37.4 | 81.2 | 7.6 | 74.3 | 19.1 | 131.9 | 66.6 |
| AD-1136242.1 | 119.9 | 28.2 | 142.2 | 79.5 | 94.5 | 17.8 | 89.0 | 65.8 |
| AD-1136243.1 | 81.2 | 2.4 | 69.7 | 15.0 | 94.7 | 32.0 | 109.6 | 46.7 |
| AD-1136244.1 | 66.9 | 32.5 | 66.8 | 3.3 | 67.7 | 11.6 | 53.6 | 1.6 |
| AD-1136245.1 | 89.6 | 25.0 | 85.4 | 14.5 | 79.9 | 32.3 | 54.9 | 11.8 |
| AD-1136246.1 | 70.6 | 9.3 | 67.8 | 7.7 | 69.2 | 18.8 | 47.9 | 14.6 |
| AD-1136247.1 | 99.4 | 30.6 | 69.9 | 11.6 | 51.5 | 14.4 | 64.9 | 23.9 |
| AD-1136248.1 | 68.2 | 10.9 | 66.0 | 7.4 | 82.0 | 32.8 | 62.3 | 9.7 |
| AD-1136249.1 | 137.1 | 53.3 | 111.3 | 46.1 | 66.0 | 44.0 | 101.4 | 105.9 |
| AD-1136250.1 | 112.9 | 11.1 | 143.8 | 8.3 | 121.6 | 19.0 | 104.3 | 22.7 |
| AD-1136251.1 | 108.3 | 30.3 | 149.1 | 26.0 | 135.9 | 15.9 | 160.4 | 106.8 |
| AD-1136252.1 | 94.4 | 5.2 | 127.0 | 37.2 | 125.2 | 5.1 | 97.7 | 35.3 |
| AD-1136253.1 | 112.3 | 16.8 | 130.1 | 14.8 | 127.2 | 23.0 | 182.7 | 108.0 |
| AD-1136254.1 | 148.8 | 15.9 | 129.8 | 30.2 | 140.8 | 26.9 | 82.2 | 50.6 |
| AD-1136255.1 | 103.0 | 20.9 | 119.4 | 32.1 | 141.8 | 42.9 | 90.3 | 54.0 |
| AD-1136256.1 | 124.3 | 41.8 | 108.0 | 22.9 | 89.3 | 27.9 | 118.4 | 27.6 |
| AD-1136257.1 | 123.8 | 50.0 | 97.2 | 20.6 | 104.0 | 6.6 | 52.4 | 7.6 |
| AD-1136258.1 | 61.2 | 10.2 | 124.6 | 23.8 | 118.5 | 24.8 | 117.7 | 16.9 |
| AD-1136259.1 | 89.2 | 26.4 | 120.0 | 20.2 | 143.7 | 13.9 | 98.8 | 5.8 |
| AD-1136260.1 | 93.3 | 22.2 | 135.4 | 22.6 | 152.5 | 34.4 | 150.5 | 27.6 |
| AD-1136261.1 | 80.6 | 17.3 | 111.9 | 13.8 | 125.0 | 33.0 | 127.6 | 29.7 |
| AD-1136262.1 | 71.8 | 12.8 | 113.2 | 7.6 | 133.9 | 2.7 | 104.6 | 9.0 |
| AD-1136263.1 | 81.0 | 20.7 | 93.6 | 19.1 | 105.3 | 24.0 | 101.2 | 8.5 |
| AD-1136264.1 | 73.3 | 13.3 | 82.8 | 20.6 | 85.6 | 8.3 | N/A | N/A |
| AD-1136265.1 | 102.0 | 12.2 | 122.2 | 19.5 | 103.1 | 11.1 | N/A | N/A |
| AD-1136266.1 | 95.9 | 22.1 | 117.0 | 27.4 | 120.9 | 15.0 | 100.2 | 22.0 |
| AD-1136267.1 | 102.3 | 18.1 | 149.1 | 13.2 | 156.4 | 45.6 | 197.8 | 80.6 |
| AD-1136268.1 | 95.8 | 20.1 | 161.8 | 23.0 | 96.2 | 20.3 | N/A | N/A |
| AD-1136269.1 | 83.5 | 12.5 | 129.0 | 9.1 | 113.2 | 17.3 | 153.8 | 51.2 |
| AD-1136270.1 | 116.6 | 19.9 | 112.3 | 10.5 | 115.9 | 21.3 | 91.9 | 27.5 |
| AD-1136271.1 | 82.9 | 24.6 | 81.1 | 12.3 | 68.2 | 20.5 | 67.0 | 28.6 |
| AD-1136272.1 | 71.3 | 14.3 | 86.2 | 8.9 | 94.2 | 15.6 | 78.1 | 10.3 |
| AD-1136273.1 | 77.6 | 16.4 | 125.1 | 10.3 | 129.3 | 21.4 | 107.4 | 17.7 |

TABLE 5-continued

Xanthine Dehydrogenase dsRNA Agent In Vitro Single Dose Screens in Primary Cynomolgus Hepatocytes

| Duplex ID | PCH | | | | | | | |
|---|---|---|---|---|---|---|---|---|
| | 500 nM | | 100 nM | | 10 nM | | 0.1 nM | |
| | % of Avg Message Remaining | STDEV | % of Avg Message Remaining | STDEV | % of Avg Message Remaining | STDEV | % of Avg Message Remaining | STDEV |
| AD-1136274.1 | 96.3 | 30.6 | 169.2 | 39.0 | 104.4 | 19.2 | 333.6 | 177.6 |
| AD-1136275.1 | 103.6 | 13.0 | 146.3 | 17.2 | 97.7 | 21.7 | N/A | N/A |
| AD-1136276.1 | 101.7 | 13.3 | 143.9 | 30.2 | 133.7 | 27.5 | 129.2 | 42.3 |
| AD-1136277.1 | 82.3 | 22.6 | 103.5 | 6.1 | 106.7 | 33.3 | 80.3 | 17.4 |
| AD-1136278.1 | 69.5 | 29.9 | 93.6 | 24.6 | 85.4 | 23.3 | 72.6 | 22.4 |
| AD-1136279.1 | 64.1 | 9.0 | 94.7 | 12.9 | 78.5 | 33.4 | 76.7 | 31.1 |
| AD-1136280.1 | 74.3 | 22.3 | 107.2 | 15.8 | 108.0 | 23.7 | 85.2 | 28.9 |
| AD-1136281.1 | 123.8 | 23.0 | 148.2 | 30.4 | 117.0 | 11.9 | 135.4 | 32.4 |
| AD-1136282.1 | 86.4 | 24.8 | 147.3 | 39.3 | 153.6 | 19.2 | 257.4 | 178.0 |
| AD-1136283.1 | 63.2 | 20.2 | 85.5 | 26.9 | 110.6 | 32.6 | N/A | N/A |
| AD-1136284.1 | 84.0 | 14.1 | 114.3 | 11.9 | 77.9 | 18.0 | 208.9 | 84.2 |
| AD-1136285.1 | 88.8 | 16.1 | 93.0 | 29.4 | 103.1 | 17.1 | 82.9 | 20.6 |
| AD-1136286.1 | 66.0 | 10.5 | 59.8 | 8.7 | 51.2 | 30.0 | 60.3 | 14.0 |
| AD-1136287.1 | 76.6 | 25.4 | 97.0 | 12.8 | 89.7 | 14.3 | 145.0 | 110.3 |
| AD-1136288.1 | 73.0 | 23.3 | 99.8 | 28.2 | 107.0 | 10.2 | 86.6 | 11.2 |
| AD-1136289.1 | 79.0 | 9.3 | 104.0 | 20.5 | 144.6 | 8.6 | 141.6 | 41.6 |
| AD-1136290.1 | 75.1 | 17.2 | 117.4 | 20.4 | 80.4 | 14.3 | N/A | N/A |
| AD-1136291.1 | 50.6 | 10.3 | 73.9 | 19.4 | 80.5 | 34.1 | N/A | N/A |
| AD-1136292.1 | 65.8 | 10.9 | 93.5 | 14.3 | 84.7 | 26.4 | 113.4 | 37.8 |
| AD-1136293.1 | 78.3 | 7.4 | 82.1 | 9.9 | 65.6 | 20.3 | 71.4 | 17.4 |
| AD-1136294.1 | 59.4 | 7.5 | 81.6 | 12.2 | 62.3 | 38.5 | 114.0 | 82.5 |
| AD-1136295.1 | 68.9 | 9.1 | 98.9 | 19.2 | 115.6 | 12.7 | 93.5 | 16.7 |
| AD-1136296.1 | 85.6 | 23.0 | 121.5 | 13.0 | 91.4 | 14.3 | 107.7 | 15.6 |
| AD-1136297.1 | 92.2 | 24.2 | 126.8 | 24.1 | 73.8 | 13.7 | 218.7 | 44.7 |
| AD-1136298.1 | 89.7 | 11.3 | 91.1 | 3.2 | 75.8 | 11.0 | N/A | N/A |
| AD-1136299.1 | 75.7 | 4.3 | 112.6 | 26.8 | 76.8 | 9.4 | 98.1 | 10.5 |
| AD-1136300.1 | 79.9 | 23.9 | 99.6 | 13.2 | 85.8 | 28.4 | 77.2 | 1.8 |
| AD-1136301.1 | 81.3 | 16.5 | 58.9 | 10.8 | 75.2 | 18.8 | 52.9 | 10.3 |
| AD-1136302.1 | 69.9 | 22.1 | 102.0 | 40.8 | 70.5 | 23.3 | 73.7 | 9.2 |
| AD-1136303.1 | 73.6 | 20.6 | 92.2 | 16.0 | 104.6 | 26.4 | 103.9 | 6.0 |
| AD-1136304.1 | 80.4 | 13.2 | 108.2 | 16.5 | 102.0 | 12.2 | 106.9 | 40.0 |
| AD-1136305.1 | 79.2 | 12.9 | 114.0 | 17.1 | 105.6 | 28.9 | N/A | N/A |
| AD-1136306.1 | 78.0 | 6.6 | 111.2 | 15.3 | 100.5 | 23.9 | N/A | N/A |
| AD-1136307.1 | 76.1 | 12.7 | 115.6 | 28.5 | 83.8 | 15.3 | 96.8 | 21.5 |

TABLE 5-continued

Xanthine Dehydrogenase dsRNA Agent In Vitro Single Dose Screens in Primary Cynomolgus Hepatocytes

| | PCH | | | | | | | |
|---|---|---|---|---|---|---|---|---|
| | 500 nM | | 100 nM | | 10 nM | | 0.1 nM | |
| Duplex ID | % of Avg Message Remaining | STDEV | % of Avg Message Remaining | STDEV | % of Avg Message Remaining | STDEV | % of Avg Message Remaining | STDEV |
| AD-1136308.1 | 67.4 | 17.1 | 66.7 | 21.3 | 63.3 | 17.1 | 67.4 | 5.6 |
| AD-1136309.1 | 65.1 | 26.6 | 79.8 | 11.5 | 74.5 | 4.1 | 60.7 | 23.8 |
| AD-1136310.1 | 71.3 | 22.6 | 76.1 | 16.3 | 108.9 | 35.2 | 71.2 | 25.5 |
| AD-1136311.1 | 59.3 | 9.8 | 94.5 | 8.0 | 96.2 | 14.4 | 89.3 | 17.7 |
| AD-1136312.1 | 63.7 | 6.0 | 105.0 | 12.9 | 90.5 | 5.7 | 89.3 | 11.6 |
| AD-1136313.1 | 75.7 | 3.9 | 105.1 | 37.5 | 89.8 | 21.6 | 88.8 | 19.0 |
| AD-1136314.1 | 108.8 | 17.9 | 95.8 | 12.0 | 83.8 | 21.1 | 87.0 | 23.5 |
| AD-1136315.1 | 92.0 | 15.8 | 83.7 | 15.5 | 77.1 | 13.5 | 73.5 | 18.1 |
| AD-1136316.1 | 85.1 | 16.3 | 66.7 | 10.9 | 60.0 | 8.0 | 49.3 | 11.8 |
| AD-1136317.1 | 64.5 | 7.9 | 72.5 | 16.7 | 89.9 | 21.4 | 77.8 | 9.4 |
| AD-1136318.1 | 88.2 | 12.5 | 86.4 | 13.6 | 91.0 | 17.1 | 105.4 | 24.8 |
| AD-1136319.1 | 63.9 | 18.5 | 120.7 | 38.2 | 119.4 | 20.1 | 92.4 | 19.3 |
| AD-1136320.1 | 68.9 | 15.0 | 100.9 | 9.9 | 105.8 | 27.7 | 89.6 | 9.0 |
| AD-1136321.1 | 96.1 | 24.6 | 91.0 | 32.8 | 90.1 | 16.5 | 73.3 | 9.0 |
| AD-1136322.1 | 101.9 | 24.1 | 80.8 | 18.8 | 63.5 | 11.5 | 71.3 | 20.1 |
| AD-1136323.1 | 73.2 | 15.8 | 62.6 | 22.8 | 61.0 | 18.6 | 68.1 | 27.7 |
| AD-1136324.1 | 110.1 | 12.5 | 88.6 | 18.2 | 87.0 | 9.3 | 63.6 | 11.8 |
| AD-1136325.1 | 83.4 | 16.1 | 90.3 | 7.4 | 81.7 | 17.5 | 65.5 | 25.1 |
| AD-1136326.1 | 87.7 | 28.8 | 101.2 | 12.0 | 70.3 | 15.4 | 59.2 | 11.4 |
| AD-1136327.1 | 142.0 | 57.3 | 137.3 | 10.5 | 63.4 | 8.7 | 85.7 | 13.0 |
| AD-1136328.1 | 90.4 | 10.6 | 85.2 | 11.8 | 91.7 | 31.9 | 63.8 | 21.7 |
| AD-1136329.1 | 79.2 | 17.1 | 89.8 | 26.0 | 49.4 | 9.6 | 52.0 | 7.9 |
| AD-1136330.1 | 125.2 | 36.0 | 78.1 | 21.5 | 76.5 | 9.9 | 67.1 | 22.8 |
| AD-1136331.1 | 100.0 | 34.1 | 81.0 | 2.9 | 86.7 | 13.1 | 64.3 | 25.9 |
| AD-1136332.1 | 106.9 | 22.8 | 72.0 | 38.2 | 69.4 | 23.1 | 54.3 | 20.7 |
| AD-1136333.1 | 76.4 | 29.8 | 110.9 | 45.1 | 61.2 | 8.1 | 59.3 | 14.5 |
| AD-1136334.1 | 105.3 | 58.3 | 93.3 | 14.6 | 49.5 | 19.3 | 47.3 | 21.0 |
| AD-1136335.1 | 71.5 | 11.5 | 113.4 | 24.5 | 76.3 | 28.7 | 70.0 | 40.8 |
| AD-1136336.1 | 136.1 | 69.8 | 104.1 | 23.7 | 81.2 | 23.9 | 57.7 | 18.1 |
| AD-1136337.1 | 87.1 | 35.7 | 100.8 | 20.0 | 59.4 | 28.2 | 38.8 | 8.9 |
| AD-1136338.1 | 124.5 | 31.0 | 86.8 | 14.0 | 51.3 | 4.8 | 77.9 | 75.1 |

Example 3. Additional Duplexes Targeting XDH

Additional duplexes targeting the xanthine dehydrogenase (XDH) gene, (human: NCBI refseqID NM_000379; NCBI GeneID: 7498) were designed using custom R and Python scripts. The human NM_000379 REFSEQ mRNA, version 4, has a length of 5715 bases.

siRNAs were synthesized and annealed using routine methods known in the art and described above.

Detailed lists of the unmodified XDH sense and antisense strand nucleotide sequences are shown in Table 6. Detailed lists of the modified XDH sense and antisense strand nucleotide sequences are shown in Table 7.

The additional duplexes for screened for activity in vitro.

Free uptake experiments were performed by adding 2.5 μl of siRNA duplexes in PBS per well into a 96 well plate. Complete growth media (47.5 μl) containing about $1.5 \times 10^4$ PMH or PHH was then added to the siRNA. Cells were incubated for 48 hours prior to RNA purification and RT-qPCR. Single dose experiments in PHH were performed at 500 nM, 100 nM, 10 nM and/or 0.1 nM in PHH and in PMH at 500 nM, 100 nM, nM, and 1 nM final duplex concentration.

For transfection, PHH cells were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 μl of Opti-MEM plus 0.1 μl of Lipofectamine RNAiMax per well (Invitrogen, Carlsbad Calif. cat #13778-150) to 2.5 μl of each siRNA duplex to an individual well in a 384-well plate. The mixture was then incubated at room temperature for 15 minutes. Forty μl of complete growth media without antibiotic containing ~$1.5 \times 10^4$ PHH cells were then added to the siRNA mixture. Cells were incubated for 24 hours prior to RNA purification. Single dose experiments were performed at 100 nM, 20 nM, 4 nM, 0.8 nM, 0.16 nM, 0.032 nM, 0.0064 nM, 0.00128 nM and 0.0001256 nM final duplex concentration.

Total RNA isolation was performed using DYNABEADS. Briefly, cells were lysed in 10 μl of Lysis/Binding Buffer containing 3 μL of beads per well and mixed for 10 minutes on an electrostatic shaker. The washing steps were automated on a Biotek EL406, using a magnetic plate support. Beads were washed (in 3 μL) once in Buffer A, once in Buffer B, and twice in Buffer E, with aspiration steps in between. Following a final aspiration, complete 12 μL RT mixture was added to each well, as described below.

For cDNA synthesis, a master mix of 1.5 μl 10× Buffer, 0.6 μl 10×dNTPs, 1.5 μl Random primers, 0.75 μl Reverse Transcriptase, 0.75 μl RNase inhibitor and 9.9 μl of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

RT-qPCR was performed as described above and relative fold change was calculated as described above.

The results of the free uptake experiments of the dsRNA agents listed in Tables 6 and 7 in PHH are shown in Tables 8 and 9. The results of the transfection experiments of the dsRNA agents listed in Tables 6 and 7 in PHH are shown in Tables 10-12. The $IC_{50}$ values for the dsRNA agents from Tables 10-12 are included in Table 13.

TABLE 6

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
| --- | --- | --- | --- | --- | --- | --- |
| AD-1135990.2 | GCACAGUGAUGCUCUCCAAGU | 34 | 228-248 | ACUUGGAGAGCAUCACUGUGCAA | 393 | 226-248 |
| AD-1135991.2 | CACAGUGAUGCUCUCCAAGUU | 35 | 229-249 | AACUUGGAGAGCAUCACUGUGCA | 394 | 227-249 |
| AD-1297597.1 | ACAGUGAUGCUCUCCAAGUAU | 1818 | 230-250 | AUACUUGGAGAGCAUCACUGUGC | 1934 | 228-250 |
| AD-1297598.1 | CAGUGAUGCUCUCCAAGUAUU | 1819 | 231-251 | AAUACUUGGAGAGCAUCACUGUG | 1935 | 229-251 |
| AD-1297599.1 | AGUGAUGCUCUCCAAGUAUGU | 1820 | 232-252 | ACAUACUUGGAGAGCAUCACUGU | 1936 | 230-252 |
| AD-1297600.1 | GUGAUGCUCUCCAAGUAUGAU | 1821 | 233-253 | AUCAUACUUGGAGAGCAUCACUG | 1937 | 231-253 |
| AD-1297601.1 | UGAUGCUCUCCAAGUAUGAUU | 1822 | 234-254 | AAUCAUACUUGGAGAGCAUCACU | 1938 | 232-254 |
| AD-1135992.2 | GAUGCUCUCCAAGUAUGAUCU | 36 | 235-255 | AGAUCAUACUUGGAGAGCAUCAC | 395 | 233-255 |
| AD-1135993.2 | AUGCUCUCCAAGUAUGAUCGU | 37 | 236-256 | ACGAUCAUACUUGGAGAGCAUCA | 396 | 234-256 |
| AD-1135994.2 | UGCUCUCCAAGUAUGAUCGUU | 38 | 237-257 | AACGAUCAUACUUGGAGAGCAUC | 397 | 235-257 |
| AD-1135995.2 | GCUCUCCAAGUAUGAUCGUCU | 39 | 238-258 | AGACGAUCAUACUUGGAGAGCAU | 398 | 236-258 |
| AD-1135996.2 | CUCUCCAAGUAUGAUCGUCUU | 40 | 239-259 | AAGACGAUCAUACUUGGAGAGCA | 399 | 237-259 |
| AD-1297602.1 | UCUCCAAGUAUGAUCGUCUGU | 1823 | 240-260 | ACAGACGAUCAUACUUGGAGAGC | 1939 | 238-260 |
| AD-1297603.1 | CUCCAAGUAUGAUCGUCUGCU | 1824 | 241-261 | AGCAGACGAUCAUACUUGGAGAG | 1940 | 239-261 |
| AD-1297604.1 | UCCAAGUAUGAUCGUCUGCAU | 1825 | 242-262 | AUGCAGACGAUCAUACUUGGAGA | 1941 | 240-262 |
| AD-1297605.1 | CCAAGUAUGAUCGUCUGCAGU | 1826 | 243-263 | ACUGCAGACGAUCAUACUUGGAG | 1942 | 241-263 |
| AD-1297606.1 | CAAGUAUGAUCGUCUGCAGAU | 1827 | 244-264 | AUCUGCAGACGAUCAUACUUGGA | 1943 | 242-264 |

TABLE 6-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1297607.1 | AAGUAUGAUCGUCUGCAGAAU | 1828 | 245-265 | AUUCTGCAGACGAUCAUACUUGG | 1944 | 243-265 |
| AD-1297608.1 | AGUAUGAUCGUCUGCAGAACU | 1829 | 246-266 | AGUUCUGCAGACGAUCAUACUUG | 1945 | 244-266 |
| AD-1297609.1 | GUAUGAUCGUCUGCAGAACAU | 1830 | 247-267 | AUGUTCUGCAGACGAUCAUACUU | 1946 | 245-267 |
| AD-1297610.1 | UAUGAUCGUCUGCAGAACAAU | 1831 | 248-268 | AUUGUUCUGCAGACGAUCAUACU | 1947 | 246-268 |
| AD-1297611.1 | AUGAUCGUCUGCAGAACAAGU | 1832 | 249-269 | ACUUGUUCUGCAGACGAUCAUAC | 1948 | 247-269 |
| AD-1136037.2 | GGGAGUAUUUCUCAGCAUUCU | 81 | 1320-1340 | AGAAUGCUGAGAAAUACUCCCCC | 440 | 1318-1340 |
| AD-1136038.2 | GGAGUAUUUCUCAGCAUUCAU | 82 | 1321-1341 | AUGAAUGCUGAGAAAUACUCCCC | 441 | 1319-1341 |
| AD-1136039.2 | GAGUAUUUCUCAGCAUUCAAU | 83 | 1322-1342 | AUUGAAUGCUGAGAAAUACUCCC | 442 | 1320-1342 |
| AD-1136040.2 | AGUAUUUCUCAGCAUUCAAGU | 84 | 1323-1343 | ACUUGAAUGCUGAGAAAUACUCC | 443 | 1321-1343 |
| AD-1136041.2 | GUAUUUCUCAGCAUUCAAGCU | 85 | 1324-1344 | AGCUUGAAUGCUGAGAAAUACUC | 444 | 1322-1344 |
| AD-1297612.1 | UAUUUCUCAGCAUUCAAGCAU | 1833 | 1325-1345 | AUGCUUGAAUGCUGAGAAAUACU | 1949 | 1323-1345 |
| AD-1297613.1 | AUUUCUCAGCAUUCAAGCAGU | 1834 | 1326-1346 | ACUGCUUGAAUGCUGAGAAAUAC | 1950 | 1324-1346 |
| AD-1297614.1 | UUUCUCAGCAUUCAAGCAGGU | 1835 | 1327-1347 | ACCUGCUUGAAUGCUGAGAAAUA | 1951 | 1325-1347 |
| AD-1297615.1 | UUCUCAGCAUUCAAGCAGGCU | 1836 | 1328-1348 | AGCCUGCUUGAAUGCUGAGAAAU | 1952 | 1326-1348 |
| AD-1297616.1 | UCUCAGCAUUCAAGCAGGCCU | 1837 | 1329-1349 | AGGCCUGCUUGAAUGCUGAGAAA | 1953 | 1327-1349 |
| AD-1297617.1 | CUCAGCAUUCAAGCAGGCCUU | 1838 | 1330-1350 | AAGGCCUGCUUGAAUGCUGAGAA | 1954 | 1328-1350 |
| AD-1297618.1 | UCAGCAUUCAAGCAGGCCUCU | 1839 | 1331-1351 | AGAGGCCUGCUUGAAUGCUGAGA | 1955 | 1329-1351 |
| AD-1297619.1 | CAGCAUUCAAGCAGGCCUCCU | 1840 | 1332-1352 | AGGAGGCCUGCUUGAAUGCUGAG | 1956 | 1330-1352 |
| AD-1297620.1 | AAGAAGGUUCCAGGGUUUGUU | 1841 | 1955-1975 | AACAAACCCUGGAACCUUCUUAG | 1957 | 1953-1975 |
| AD-1297621.1 | AGAAGGUUCCAGGGUUUGUUU | 1842 | 1956-1976 | AAACAAACCCUGGAACCUUCUUA | 1958 | 1954-1976 |
| AD-1297622.1 | GAAGGUUCCAGGGUUUGUUUU | 1843 | 1957-1977 | AAAACAAACCCUGGAACCUUCUU | 1959 | 1955-1977 |
| AD-1297623.1 | AAGGUUCCAGGGUUUGUUUGU | 1844 | 1958-1978 | ACAAACAAACCCUGGAACCUUCU | 1960 | 1956-1978 |
| AD-1297624.1 | AGGUUCCAGGGUUUGUUUGUU | 1845 | 1959-1979 | AACAAACAAACCCUGGAACCUUC | 1961 | 1957-1979 |
| AD-1297625.1 | GGUUCCAGGGUUUGUUUGUUU | 1846 | 1960-1980 | AAACAAACAAACCCUGGAACCUU | 1962 | 1958-1980 |
| AD-1297626.1 | GUUCCAGGGUUUGUUUGUUUU | 1847 | 1961-1981 | AAAACAAACAAACCCUGGAACCU | 1963 | 1959-1981 |
| AD-1136050.2 | UUCCAGGGUUUGUUUGUUUCU | 94 | 1962-1982 | AGAAACAAACAAACCCUGGAACC | 453 | 1960-1982 |
| AD-1297627.1 | UCCAGGGUUUGUUUGUUUCAU | 1848 | 1963-1983 | AUGAAACAAACAAACCCUGGAAC | 1964 | 1961-1983 |
| AD-1297628.1 | CCAGGGUUUGUUUGUUUCAUU | 1849 | 1964-1984 | AAUGAAACAAACAAACCCUGGAA | 1965 | 1962-1984 |
| AD-1136051.2 | CAGGGUUUGUUUGUUUCAUUU | 95 | 1965-1985 | AAAUGAAACAAACAAACCCUGGA | 454 | 1963-1985 |
| AD-1136052.2 | GGGUUUGUUUGUUUCAUUUCU | 96 | 1967-1987 | AGAAAUGAAACAAACAAACCCUG | 455 | 1965-1987 |
| AD-1136053.2 | GGUUUGUUUGUUUCAUUUCCU | 97 | 1968-1988 | AGGAAAUGAAACAAACAAACCCU | 456 | 1966-1988 |
| AD-1297629.1 | GUUUGUUUGUUUCAUUUCCGU | 1850 | 1969-1989 | ACGGAAAUGAAACAAACAAACCC | 1966 | 1967-1989 |
| AD-1297630.1 | UUUGUUUGUUUCAUUUCCGCU | 1851 | 1970-1990 | AGCGGAAAUGAAACAAACAAACC | 1967 | 1968-1990 |
| AD-1136054.2 | UUGUUUGUUUCAUUUCCGCUU | 98 | 1971-1991 | AAGCGGAAAUGAAACAAACAAAC | 457 | 1969-1991 |
| AD-1297631.1 | UGUUUGUUUCAUUUCCGCUGU | 1852 | 1972-1992 | ACAGCGGAAAUGAAACAAACAAA | 1968 | 1970-1992 |
| AD-1297632.1 | GUUUGUUUCAUUUCCGCUGAU | 1853 | 1973-1993 | AUCAGCGGAAAUGAAACAAACAA | 1969 | 1971-1993 |
| AD-1297633.1 | UUUGUUUCAUUUCCGCUGAUU | 1854 | 1974-1994 | AAUCAGCGGAAAUGAAACAAACA | 1970 | 1972-1994 |

TABLE 6-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1297634.1 | UUGUUUCAUUUCCGCUGAUGU | 1855 | 1975-1995 | ACAUCAGCGGAAAUGAAACAAAC | 1971 | 1973-1995 |
| AD-1297635.1 | UGUUUCAUUUCCGCUGAUGAU | 1856 | 1976-1996 | AUCAUCAGCGGAAAUGAAACAAA | 1972 | 1974-1996 |
| AD-1297636.1 | GUUUCAUUUCCGCUGAUGAUU | 1857 | 1977-1997 | AAUCAUCAGCGGAAAUGAAACAA | 1973 | 1975-1997 |
| AD-1297637.1 | UUUCAUUUCCGCUGAUGAUGU | 1858 | 1978-1998 | ACAUCAUCAGCGGAAAUGAAACA | 1974 | 1976-1998 |
| AD-1297638.1 | GGAGAUGGAGCUCUUUGUGUU | 1859 | 2353-2373 | AACACAAAGAGCUCCAUCUCCCC | 1975 | 2351-2373 |
| AD-1297639.1 | GAGAUGGAGCUCUUUGUGUCU | 1860 | 2354-2374 | AGACACAAAGAGCUCCAUCUCCC | 1976 | 2352-2374 |
| AD-1297640.1 | AGAUGGAGCUCUUUGUGUCUU | 1861 | 2355-2375 | AAGACACAAAGAGCUCCAUCUCC | 1977 | 2353-2375 |
| AD-1297641.1 | GAUGGAGCUCUUUGUGUCUAU | 1862 | 2356-2376 | AUAGACACAAAGAGCUCCAUCUC | 1978 | 2354-2376 |
| AD-1297642.1 | AUGGAGCUCUUUGUGUCUACU | 1863 | 2357-2377 | AGUAGACACAAAGAGCUCCAUCU | 1979 | 2355-2377 |
| AD-1297643.1 | UGGAGCUCUUUGUGUCUACAU | 1864 | 2358-2378 | AUGUAGACACAAAGAGCUCCAUC | 1980 | 2356-2378 |
| AD-1297644.1 | GGAGCUCUUUGUGUCUACACU | 1865 | 2359-2379 | AGUGUAGACACAAAGAGCUCCAU | 1981 | 2357-2379 |
| AD-1297645.1 | GAGCUCUUUGUGUCUACACAU | 1866 | 2360-2380 | AUGUGUAGACACAAAGAGCUCCA | 1982 | 2358-2380 |
| AD-1136073.2 | AGCUCUUUGUGUCUACACAGU | 117 | 2361-2381 | ACUGUGUAGACACAAAGAGCUCC | 476 | 2359-2381 |
| AD-1136074.2 | GCUCUUUGUGUCUACACAGAU | 118 | 2362-2382 | AUCUGUGUAGACACAAAGAGCUC | 477 | 2360-2382 |
| AD-1136075.2 | CUCUUUGUGUCUACACAGAAU | 119 | 2363-2383 | AUUCUGUGUAGACACAAAGAGCU | 478 | 2361-2383 |
| AD-1136076.2 | UCUUUGUGUCUACACAGAACU | 120 | 2364-2384 | AGUUCUGUGUAGACACAAAGAGC | 479 | 2362-2384 |
| AD-1136077.2 | CUUUGUGUCUACACAGAACAU | 121 | 2365-2385 | AUGUCUGUGUAGACACAAAGAG | 480 | 2363-2385 |
| AD-1136078.2 | UUUGUGUCUACACAGAACACU | 122 | 2366-2386 | AGUGUUCUGUGUAGACACAAAGA | 481 | 2364-2386 |
| AD-1297646.1 | UUGUGUCUACACAGAACACCU | 1867 | 2367-2387 | AGGUGUCUGUGUAGACACAAAG | 1983 | 2365-2387 |
| AD-1297647.1 | UGUGUCUACACAGAACACCAU | 1868 | 2368-2388 | AUGGUGUUCUGUGUAGACACAAA | 1984 | 2366-2388 |
| AD-1297648.1 | GUGUCUACACAGAACACCAUU | 1869 | 2369-2389 | AAUGGUGUUCUGUGUAGACACAA | 1985 | 2367-2389 |
| AD-1297649.1 | UGUCUACACAGAACACCAUGU | 1870 | 2370-2390 | ACAUGGUGUUCUGUGUAGACACA | 1986 | 2368-2390 |
| AD-1297650.1 | GUCUACACAGAACACCAUGAU | 1871 | 2371-2391 | AUCAUGGUGUUCUGUGUAGACAC | 1987 | 2369-2391 |
| AD-1297651.1 | UCUACACAGAACACCAUGAAU | 1872 | 2372-2392 | AUUCAUGGUGUUCUGUGUAGACA | 1988 | 2370-2392 |
| AD-1297652.1 | CUACACAGAACACCAUGAAGU | 1873 | 2373-2393 | ACUUCAUGGUGUUCUGUGUAGAC | 1989 | 2371-2393 |
| AD-1297653.1 | UACACAGAACACCAUGAAGAU | 1874 | 2374-2394 | AUCUUCAUGGUGUUCUGUGUAGA | 1990 | 2372-2394 |
| AD-1297654.1 | GGGAACACCCAGGAUCUCUCU | 1875 | 2681-2701 | AGAGAGAUCCUGGGUGUUCCCCA | 1991 | 2679-2701 |
| AD-1297655.1 | GGAACACCCAGGAUCUCUCUU | 1876 | 2682-2702 | AAGAGAGAUCCUGGGUGUUCCCC | 1992 | 2680-2702 |
| AD-1297656.1 | GAACACCCAGGAUCUCUCUCU | 1877 | 2683-2703 | AGAGAGAGAUCCUGGGUGUUCCC | 1993 | 2681-2703 |
| AD-1297657.1 | AACACCCAGGAUCUCUCUCAU | 1878 | 2684-2704 | AUGAGAGAGAUCCUGGGUGUUCC | 1994 | 2682-2704 |
| AD-1297658.1 | ACACCCAGGAUCUCUCUCAGU | 1879 | 2685-2705 | ACUGAGAGAGAUCCUGGGUGUUC | 1995 | 2683-2705 |
| AD-1297659.1 | CACCCAGGAUCUCUCUCAGAU | 1880 | 2686-2706 | AUCUGAGAGAGAUCCUGGGUGUU | 1996 | 2684-2706 |
| AD-1297660.1 | ACCCAGGAUCUCUCUCAGAGU | 1881 | 2687-2707 | ACUCUGAGAGAGAUCCUGGGUGU | 1997 | 2685-2707 |
| AD-1297661.1 | CCCAGGAUCUCUCUCAGAGUU | 1882 | 2688-2708 | AACUCUGAGAGAGAUCCUGGGUG | 1998 | 2686-2708 |
| AD-1297662.1 | CCAGGAUCUCUCUCAGAGUAU | 1883 | 2689-2709 | AUACUCUGAGAGAGAUCCUGGGU | 1999 | 2687-2709 |
| AD-1297663.1 | CAGGAUCUCUCUCAGAGUAUU | 1884 | 2690-2710 | AAUACUCUGAGAGAGAUCCUGGG | 2000 | 2688-2710 |
| AD-1136082.2 | AGGAUCUCUCUCAGAGUAUUU | 126 | 2691-2711 | AAAUACUCUGAGAGAGAUCCUGG | 485 | 2689-2711 |

TABLE 6-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136083.2 | GGAUCUCUCUCAGAGUAUUAU | 127 | 2692-2712 | AUAAUACUCUGAGAGAUCCUG | 486 | 2690-2712 |
| AD-1136084.2 | GAUCUCUCUCAGAGUAUUAUU | 128 | 2693-2713 | AAUAAUACUCUGAGAGAUCCU | 487 | 2691-2713 |
| AD-1136085.2 | AUCUCUCUCAGAGUAUUAUGU | 129 | 2694-2714 | ACAUAAUACUCUGAGAGAUCC | 488 | 2692-2714 |
| AD-1136086.2 | UCUCUCUCAGAGUAUUAUGGU | 130 | 2695-2715 | ACCAUAAUACUCUGAGAGAUC | 489 | 2693-2715 |
| AD-1136087.2 | CUCUCUCAGAGUAUUAUGGAU | 131 | 2696-2716 | AUCCAUAAUACUCUGAGAGAU | 490 | 2694-2716 |
| AD-1136088.2 | UCUCUCAGAGUAUUAUGGAAU | 132 | 2697-2717 | AUUCCAUAAUACUCUGAGAGA | 491 | 2695-2717 |
| AD-1136089.2 | CUCUCAGAGUAUUAUGGAACU | 133 | 2698-2718 | AGUUCCAUAAUACUCUGAGAG | 492 | 2696-2718 |
| AD-1136090.2 | UCUCAGAGUAUUAUGGAACGU | 134 | 2699-2719 | ACGUUCCAUAAUACUCUGAGA | 493 | 2697-2719 |
| AD-1297664.1 | CUCAGAGUAUUAUGGAACGAU | 1885 | 2700-2720 | AUCGUUCCAUAAUACUCUGAG | 2001 | 2698-2720 |
| AD-1136091.2 | UCAGAGUAUUAUGGAACGAGU | 135 | 2701-2721 | ACUCGUUCCAUAAUACUCUGA | 494 | 2699-2721 |
| AD-1136092.2 | CAGAGUAUUAUGGAACGAGCU | 136 | 2702-2722 | AGCUCGUUCCAUAAUACUCUG | 495 | 2700-2722 |
| AD-1297665.1 | AGAGUAUUAUGGAACGAGCUU | 1886 | 2703-2723 | AAGCUCGUUCCAUAAUACUCUGA | 2002 | 2701-2723 |
| AD-1297666.1 | GAGUAUUAUGGAACGAGCUUU | 1887 | 2704-2724 | AAAGCUCGUUCCAUAAUACUCU | 2003 | 2702-2724 |
| AD-1297667.1 | AGUAUUAUGGAACGAGCUUUU | 1888 | 2705-2725 | AAAAGCUCGUUCCAUAAUACUCU | 2004 | 2703-2725 |
| AD-1297668.1 | GUAUUAUGGAACGAGCUUUAU | 1889 | 2706-2726 | AUAAAGCUCGUUCCAUAAUACUC | 2005 | 2704-2726 |
| AD-1297669.1 | UAUUAUGGAACGAGCUUUAUU | 1890 | 2707-2727 | AAUAAAGCUCGUUCCAUAAUACU | 2006 | 2705-2727 |
| AD-1297670.1 | AUUAUGGAACGAGCUUUAUUU | 1891 | 2708-2728 | AAAUAAAGCUCGUUCCAUAAUAC | 2007 | 2706-2728 |
| AD-1297671.1 | UUAUGGAACGAGCUUUAUUCU | 1892 | 2709-2729 | AGAAUAAAGCUCGUUCCAUAAUA | 2008 | 2707-2729 |
| AD-1297672.1 | UAUGGAACGAGCUUUAUUCCU | 1893 | 2710-2730 | AGGAAUAAAGCUCGUUCCAUAAU | 2009 | 2708-2730 |
| AD-1297673.1 | CUCUUCCUGGCUGCUUCUAUU | 1894 | 3869-3889 | AAUAGAAGCAGCCAGGAAGAGGG | 2010 | 3867-3889 |
| AD-1297674.1 | UCUUCCUGGCUGCUUCUAUCU | 1895 | 3870-3890 | AGAUAGAAGCAGCCAGGAAGAGG | 2011 | 3868-3890 |
| AD-1297675.1 | CUUCCUGGCUGCUUCUAUCUU | 1896 | 3871-3891 | AAGAUAGAAGCAGCCAGGAAGAG | 2012 | 3869-3891 |
| AD-1136159.2 | UUCCUGGCUGCUUCUAUCUUU | 202 | 3872-3892 | AAAGAUAGAAGCAGCCAGGAAGA | 561 | 3870-3892 |
| AD-1136160.2 | UCCUGGCUGCUUCUAUCUUCU | 203 | 3873-3893 | AGAAGAUAGAAGCAGCCAGGAAG | 562 | 3871-3893 |
| AD-1136161.2 | CCUGGCUGCUUCUAUCUUCUU | 204 | 3874-3894 | AAGAAGAUAGAAGCAGCCAGGAA | 563 | 3872-3894 |
| AD-1136162.2 | CUGGCUGCUUCUAUCUUCUUU | 205 | 3875-3895 | AAAGAAGAUAGAAGCAGCCAGGA | 564 | 3873-3895 |
| AD-1136163.2 | UGGCUGCUUCUAUCUUCUUUU | 206 | 3876-3896 | AAAAGAAGAUAGAAGCAGCCAGG | 565 | 3874-3896 |
| AD-1297676.1 | GGCUGCUUCUAUCUUCUUUGU | 1897 | 3877-3897 | ACAAAGAAGAUAGAAGCAGCCAG | 2013 | 3875-3897 |
| AD-1136164.2 | GCUGCUUCUAUCUUCUUUGCU | 207 | 3878-3898 | AGCAAAGAAGAUAGAAGCAGCCA | 566 | 3876-3898 |
| AD-1136165.2 | CUGCUUCUAUCUUCUUUGCCU | 208 | 3879-3899 | AGGCAAAGAAGAUAGAAGCAGCC | 567 | 3877-3899 |
| AD-1136166.2 | UGCUUCUAUCUUCUUUGCCAU | 209 | 3880-3900 | AUGGCAAAGAAGAUAGAAGCAGC | 568 | 3878-3900 |
| AD-1136167.2 | GCUUCUAUCUUCUUUGCCAUU | 210 | 3881-3901 | AAUGGCAAAGAAGAUAGAAGCAG | 569 | 3879-3901 |
| AD-1136168.2 | CUUCUAUCUUCUUUGCCAUCU | 211 | 3882-3902 | AGAUGGCAAAGAAGAUAGAAGCA | 570 | 3880-3902 |
| AD-1136169.2 | UUCUAUCUUCUUUGCCAUCAU | 212 | 3883-3903 | AUGAUGGCAAAGAAGAUAGAAGC | 571 | 3881-3903 |
| AD-1136170.2 | UCUAUCUUCUUUGCCAUCAAU | 213 | 3884-3904 | AUUGAUGGCAAAGAAGAUAGAAG | 572 | 3882-3904 |
| AD-1136171.2 | CUAUCUUCUUUGCCAUCAAAU | 214 | 3885-3905 | AUUUGAUGGCAAAGAAGAUAGAA | 573 | 3883-3905 |
| AD-1136172.2 | UAUCUUCUUUGCCAUCAAAGU | 215 | 3886-3906 | ACUUUGAUGGCAAAGAAGAUAGA | 574 | 3884-3906 |

TABLE 6-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1136173.2 | AUCUUCUUUGCCAUCAAAGAU | 216 | 3887-3907 | AUCUUGAUGGCAAAGAAGAUAG | 575 | 3885-3907 |
| AD-1297677.1 | UCUUCUUUGCCAUCAAAGAUU | 1898 | 3888-3908 | AAUCUUUGAUGGCAAAGAAGAUA | 2014 | 3886-3908 |
| AD-1136174.2 | CUUCUUUGCCAUCAAAGAUGU | 217 | 3889-3909 | ACAUCUUUGAUGGCAAAGAAGAU | 576 | 3887-3909 |
| AD-1297678.1 | UUCUUUGCCAUCAAAGAUGCU | 1899 | 3890-3910 | AGCAUCUUGAUGGCAAAGAAGA | 2015 | 3888-3910 |
| AD-1297679.1 | UCUUUGCCAUCAAAGAUGCCU | 1900 | 3891-3911 | AGGCAUCUUUGAUGGCAAAGAAG | 2016 | 3889-3911 |
| AD-1297680.1 | CUUUGCCAUCAAAGAUGCCAU | 1901 | 3892-3912 | AUGGCAUCUUUGAUGGCAAAGAA | 2017 | 3890-3912 |
| AD-1297681.1 | UUUGCCAUCAAAGAUGCCAUU | 1902 | 3893-3913 | AAUGGCAUCUUUGAUGGCAAAGA | 2018 | 3891-3913 |
| AD-1297682.1 | UUGCCAUCAAAGAUGCCAUCU | 1903 | 3894-3914 | AGAUGGCAUCUUUGAUGGCAAAG | 2019 | 3892-3914 |
| AD-1297683.1 | UGCCAUCAAAGAUGCCAUCCU | 1904 | 3895-3915 | AGGAUGGCAUCUUUGAUGGCAAA | 2020 | 3893-3915 |
| AD-1297684.1 | GCCAUCAAAGAUGCCAUCCGU | 1905 | 3896-3916 | ACGGAUGGCAUCUUUGAUGGCAA | 2021 | 3894-3916 |
| AD-1297685.1 | AAACCAUGAACAGCAAAGCU | 1906 | 4512-4532 | AGCUUUGCUGUUCAUUGGUUUGA | 2022 | 4510-4532 |
| AD-1297686.1 | AACCAUGAACAGCAAAGCAU | 1907 | 4513-4533 | AUGCUUUGCUGUUCAUUGGUUUG | 2023 | 4511-4533 |
| AD-1297687.1 | ACCAUGAACAGCAAAGCAUU | 1908 | 4514-4534 | AAUGCUUUGCUGUUCAUUGGUUU | 2024 | 4512-4534 |
| AD-1297688.1 | CCAUGAACAGCAAAGCAUAU | 1909 | 4515-4535 | AUAUGCUUUGCUGUUCAUUGGUU | 2025 | 4513-4535 |
| AD-1297689.1 | CAAUGAACAGCAAAGCAUAAU | 1910 | 4516-4536 | AUUAUGCUUUGCUGUUCAUUGGU | 2026 | 4514-4536 |
| AD-1297690.1 | AAUGAACAGCAAAGCAUAACU | 1911 | 4517-4537 | AGUUAUGCUUUGCUGUUCAUUGG | 2027 | 4515-4537 |
| AD-1297691.1 | AUGAACAGCAAAGCAUAACCU | 1912 | 4518-4538 | AGGUUAUGCUUUGCUGUUCAUUG | 2028 | 4516-4538 |
| AD-1297692.1 | UGAACAGCAAAGCAUAACCUU | 1913 | 4519-4539 | AAGGUUAUGCUUUGCUGUUCAUU | 2029 | 4517-4539 |
| AD-1136221.2 | GAACAGCAAAGCAUAACCUUU | 264 | 4520-4540 | AAAGGUUAUGCUUUGCUGUUCAU | 623 | 4518-4540 |
| AD-1136222.2 | AACAGCAAAGCAUAACCUUGU | 265 | 4521-4541 | ACAAGGUUAUGCUUUGCUGUUCA | 624 | 4519-4541 |
| AD-1297693.1 | ACAGCAAAGCAUAACCUUGAU | 1914 | 4522-4542 | AUCAAGGUUAUGCUUUGCUGUUC | 2030 | 4520-4542 |
| AD-1297694.1 | CAGCAAAGCAUAACCUUGAAU | 1915 | 4523-4543 | AUUCAAGGUUAUGCUUUGCUGUU | 2031 | 4521-4543 |
| AD-1136223.2 | AGCAAAGCAUAACCUUGAAUU | 266 | 4524-4544 | AAUUCAAGGUUAUGCUUUGCUGU | 625 | 4522-4544 |
| AD-1136224.2 | GCAAAGCAUAACCUUGAAUCU | 267 | 4525-4545 | AGAUUCAAGGUUAUGCUUUGCUG | 626 | 4523-4545 |
| AD-1136225.2 | CAAAGCAUAACCUUGAAUCUU | 268 | 4526-4546 | AAGAUUCAAGGUUAUGCUUUGCU | 627 | 4524-4546 |
| AD-1297695.1 | AAAGCAUAACCUUGAAUCUAU | 1916 | 4527-4547 | AUAGAUUCAAGGUUAUGCUUUGC | 2032 | 4525-4547 |
| AD-1297696.1 | AAGCAUAACCUUGAAUCUAUU | 1917 | 4528-4548 | AAUAGAUUCAAGGUUAUGCUUUG | 2033 | 4526-4548 |
| AD-1297697.1 | AGCAUAACCUUGAAUCUAUAU | 1918 | 4529-4549 | AUAUAGAUUCAAGGUUAUGCUUU | 2034 | 4527-4549 |
| AD-1136226.2 | GCAUAACCUUGAAUCUAUACU | 269 | 4530-4550 | AGUAUAGAUUCAAGGUUAUGCUU | 628 | 4528-4550 |
| AD-1136227.2 | CAUAACCUUGAAUCUAUACUU | 270 | 4531-4551 | AAGUAUAGAUUCAAGGUUAUGCU | 629 | 4529-4551 |
| AD-1136228.2 | AUAACCUUGAAUCUAUACUCU | 271 | 4532-4552 | AGAGUAUAGAUUCAAGGUUAUGC | 630 | 4530-4552 |
| AD-1136229.2 | UAACCUUGAAUCUAUACUCAU | 272 | 4533-4553 | AUGAGUAUAGAUUCAAGGUUAUG | 631 | 4531-4553 |
| AD-1136230.2 | AACCUUGAAUCUAUACUCAAU | 273 | 4534-4554 | AUUGAGUAUAGAUUCAAGGUUAU | 632 | 4532-4554 |
| AD-1136231.2 | ACCUUGAAUCUAUACUCAAAU | 274 | 4535-4555 | AUUUGAGUAUAGAUUCAAGGUUA | 633 | 4533-4555 |
| AD-1136232.2 | CCUUGAAUCUAUACUCAAAUU | 275 | 4536-4556 | AAUUUGAGUAUAGAUUCAAGGUU | 634 | 4534-4556 |
| AD-1297698.1 | CUUGAAUCUAUACUCAAAUUU | 1919 | 4537-4557 | AAAUUUGAGUAUAGAUUCAAGGU | 2035 | 4535-4557 |
| AD-1297699.1 | UUGAAUCUAUACUCAAAUUUU | 1920 | 4538-4558 | AAAAUUUGAGUAUAGAUUCAAGG | 2036 | 4536-4558 |

TABLE 6-continued

Unmodified Sense and Antisense Strand Sequences of Xanthine Dehydrogenase dsRNA Agents

| Duplex Name | Sense Sequence 5' to 3' | SEQ ID NO: | Range in NM_000379.4 | Antisense Sequence 5' to 3' | SEQ ID NO: | Range in NM_000379.4 |
|---|---|---|---|---|---|---|
| AD-1297700.1 | GAAUCUAUACUCAAAUUUUGU | 1921 | 4540-4560 | ACAAAAUUUGAGUAUAGAUUCAA | 2037 | 4538-4560 |
| AD-1136233.2 | AAUCUAUACUCAAAUUUUGCU | 276 | 4541-4561 | AGCAAAAUUUGAGUAUAGAUUCA | 635 | 4539-4561 |
| AD-1136234.2 | AUCUAUACUCAAAUUUUGCAU | 277 | 4542-4562 | AUGCAAAAUUUGAGUAUAGAUUC | 636 | 4540-4562 |
| AD-1297701.1 | UCUAUACUCAAAUUUUGCAAU | 1922 | 4543-4563 | AUUGCAAAAUUUGAGUAUAGAUU | 2038 | 4541-4563 |
| AD-1297702.1 | CUAUACUCAAAUUUUGCAAUU | 1923 | 4544-4564 | AAUUGCAAAAUUUGAGUAUAGAU | 2039 | 4542-4564 |
| AD-1297703.1 | UAUACUCAAAUUUUGCAAUGU | 1924 | 4545-4565 | ACAUTGCAAAAUUUGAGUAUAGA | 2040 | 4543-4565 |
| AD-1297704.1 | AUACUCAAAUUUUGCAAUGAU | 1925 | 4546-4566 | AUCAUGCAAAAUUUGAGUAUAG | 2041 | 4544-4566 |
| AD-1297705.1 | UACUCAAAUUUUGCAAUGAGU | 1926 | 4547-4567 | ACUCAUUGCAAAAUUUGAGUAUA | 2042 | 4545-4567 |
| AD-1297706.1 | ACUCAAAUUUUGCAAUGAGGU | 1927 | 4548-4568 | ACCUCAUUGCAAAAUUUGAGUAU | 2043 | 4546-4568 |
| AD-1297707.1 | CUCAAAUUUUGCAAUGAGGCU | 1928 | 4549-4569 | AGCCUCAUUGCAAAAUUUGAGUA | 2044 | 4547-4569 |
| AD-1297708.1 | UCAAAUUUUGCAAUGAGGCAU | 1929 | 4550-4570 | AUGCCUCAUUGCAAAAUUUGAGU | 2045 | 4548-4570 |
| AD-1297709.1 | CAAAUUUUGCAAUGAGGCAGU | 1930 | 4551-4571 | ACUGCCUCAUUGCAAAAUUUGAG | 2046 | 4549-4571 |
| AD-1297710.1 | AAAUUUUGCAAUGAGGCAGUU | 1931 | 4552-4572 | AACUGCCUCAUUGCAAAAUUUGA | 2047 | 4550-4572 |
| AD-1297711.1 | AAUUUUGCAAUGAGGCAGUGU | 1932 | 4553-4573 | ACACTGCCUCAUUGCAAAAUUUG | 2048 | 4551-4573 |
| AD-1297712.1 | AUUUUGCAAUGAGGCAGUGGU | 1933 | 4554-4574 | ACCACUGCCUCAUUGCAAAAUUU | 2049 | 4552-4574 |
| AD-1395794.1 | CUCUCCAAGUAUGAUCGUCUU | 40 | 239-259 | AAGACGAUCAUACUUGGAGAGCG | 2050 | 237-259 |
| AD-1395797.1 | AGGAUCUCUCAGAGUAUUU | 126 | 2691-2711 | AAAUACTCUGAGAGAUCCUGG | 485 | 2689-2711 |
| AD-1395803.1 | CAGUGAUGCUCUCCAAGUAUU | 1819 | 231-251 | AAUACUTGGAGAGCAUCACUGUG | 2051 | 229-251 |
| AD-1395805.1 | CCAAGUAUGAUCGUCUGCAGU | 1826 | 243-263 | ACUGCAGACGATCAUACUUGGAG | 2052 | 241-263 |
| AD-1395807.1 | GUUUGUUUCAUUUCCGCUGAU | 1853 | 1973-1993 | ATCAGCGGAAATGAAACAAACGG | 2053 | 1971-1993 |
| AD-1395811.1 | AACACCCAGGAUCUCUCUCAU | 1878 | 2684-2704 | ATGAGAGAGAUCCUGGGUGUUCC | 2054 | 2682-2704 |
| AD-1395816.1 | GGGUUUGUUUGUUUCAUUUCU | 96 | 1967-1987 | AGAAAUGAAACAAACAAACCCUG | 455 | 1965-1987 |
| AD-1395823.1 | GAGUAUUUCUCAGCAUUCAAU | 83 | 1322-1342 | ATUGAAUGCUGAGAAAUACUCCC | 2055 | 1320-1342 |

TABLE 7

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1135990.2 | gscsacagUfgAfUfGfcucuccaaguL96 | 752 | asCfsuudGg(Agn)gagcauCfaCfugugcsasa | 1111 | UUGCACAGUGAUGCUCUCCAAGU | 1470 |
| AD-1135991.2 | csascaguGfaUfGfCfcucuccaaguuL96 | 753 | asAfscudTg(G2p)agagcaUfcAfcugugscsa | 1112 | UGCACAGUGAUGCUCUCCAAGUA | 1471 |
| AD-1297597.1 | ascsagugAfuGfCfUfcuccaaguauL96 | 2056 | asUfsacdTu(G2p)gagagcAfuCfacugusgsc | 2180 | GCACAGUGAUGCUCUCCAAGUAU | 2304 |
| AD-1297598.1 | csasguaUfgCfUfCfuccaaguauuL96 | 2057 | asAfsuacUfuggagagCfaUfcacugsusg | 2181 | CACAGUGAUGCUCUCCAAGUAUG | 2305 |
| AD-1297599.1 | asgsugauGfcUfCfUfccaaguauguL96 | 2058 | asCfsauaCfuuggagaGfcAfucacusgsu | 2182 | ACAGUGAUGCUCUCCAAGUAUGA | 2306 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1297600.1 | gsusgaugCfuCfUfCfcaaguaugauL96 | 2059 | asUfscauAfcuuggagAfgCfaucacsusg | 2183 | CAGUGAUGCUCUCCAAGUAUGAU | 2307 |
| AD-1297601.1 | usgsaugcUfcUfCfCfaaguaugauuL96 | 2060 | asAfsucaUfacuuggaGfaGfcaucascsu | 2184 | AGUGAUGCUCUCCAAGUAUGAUC | 2308 |
| AD-1135992.2 | gsasugcuCfuCfCfAfaguaugaucuL96 | 754 | asGfsaucAfuacuuggAfgAfgcaucsasc | 1113 | GUGAUGCUCUCCAAGUAUGAUCG | 1472 |
| AD-1135993.2 | asusgcucUfcCfAfAfguaugaucguL96 | 755 | asCfsgauCfauacuugGfaGfagcauscsa | 1114 | UGAUGCUCUCCAAGUAUGAUCGU | 1473 |
| AD-1135994.2 | usgscucuCfcAfAfGfuaugaucguuL96 | 756 | asAfscgaUfcauacuuGfgAfgagcasusc | 1115 | GAUGCUCUCCAAGUAUGAUCGUC | 1474 |
| AD-1135995.2 | gscsucucCfaAfGfUfaugaucgucuL96 | 757 | asGfsacgAfucauacuUfgGfagagcsasu | 1116 | AUGCUCUCCAAGUAUGAUCGUCU | 1475 |
| AD-1135996.2 | csuscuccAfaGfUfAfugaucgucuuL96 | 758 | asAfsgacGfaucauacUfuGfgagagscsa | 1117 | UGCUCUCCAAGUAUGAUCGUCUG | 1476 |
| AD-1297602.1 | uscsuccaAfgUfAfUfgaucgucuguL96 | 2061 | asCfsagaCfgaucauaCfuUfggagasgsc | 2185 | GCUCUCCAAGUAUGAUCGUCUGC | 2309 |
| AD-1297603.1 | csusccaaGfuAfUfGfaucgucugcuL96 | 2062 | asGfscadGa(C2p)gaucauAfcUfuggagsasg | 2186 | CUCUCCAAGUAUGAUCGUCUGCA | 2310 |
| AD-1297604.1 | uscscaagUfaUfGfAfucgucugcauL96 | 2063 | asUfsgcdAg(Agn)cgaucaUfaCfuuggasgsa | 2187 | UCUCCAAGUAUGAUCGUCUGCAG | 2311 |
| AD-1297605.1 | cscsaaguAfuGfAfUfcgucugcaguL96 | 2064 | asCfsugcAfgacgaucAfuAfcuuggsasg | 2188 | CUCCAAGUAUGAUCGUCUGCAGA | 2312 |
| AD-1297606.1 | csasaguaUfgAfUfCfgucugcagauL96 | 2065 | asUfscudGc(Agn)gacgauCfaUfacuugsgsa | 2189 | UCCAAGUAUGAUCGUCUGCAGAA | 2313 |
| AD-1297607.1 | asasguauGfaUfCfGfucugcagaauL96 | 2066 | asUfsucdTg(C2p)agacgaUfcCfuacuusgsg | 2190 | CCAAGUAUGAUCGUCUGCAGAAC | 2314 |
| AD-1297608.1 | asgsuaugAfuCfGfUfcugcagaacuL96 | 2067 | asGfsuudCu(G2p)cagacgAfuCfuacususg | 2191 | CAAGUAUGAUCGUCUGCAGAACA | 2315 |
| AD-1297609.1 | gsusaugaUfcGfUfCfugcagaacauL96 | 2068 | asUfsgudTc(Tgn)gcagacGfaUfcauacsusu | 2192 | AAGUAUGAUCGUCUGCAGAACAA | 2316 |
| AD-1297610.1 | usasugauCfgUfCfUfgcagaacaauL96 | 2069 | asUfsugdTu(C2p)ugcagaCfgAfucauascsu | 2193 | AGUAUGAUCGUCUGCAGAACAAG | 2317 |
| AD-1297611.1 | asusgaucGfuCfUfGfcagaacaaguL96 | 2070 | asCfsuugUfucugcagAfcGfaucausasc | 2194 | GUAUGAUCGUCUGCAGAACAAGA | 2318 |
| AD-1136037.2 | gsgsgaguAfuUfUfCfucagcauucuL96 | 799 | asGfsaadTg(C2p)ugagaaAfuAfcucccscsc | 1158 | GGGGGAGUAUUUCUCAGCAUUCA | 1517 |
| AD-1136038.2 | gsgsaguaUfuUfCfUfcagcauucauL96 | 800 | asUfsgadAu(G2p)cugagaAfaUfacuccscsc | 1159 | GGGGAGUAUUUCUCAGCAUUCAA | 1518 |
| AD-1136039.2 | gsasguauUfuCfUfCfagcauucaauL96 | 801 | asUfsugaAfugcugagAfaAfauacucscsc | 1160 | GGGAGUAUUUCUCAGCAUUCAAG | 1519 |
| AD-1136040.2 | asgsuauuUfcUfCfAfgcauucaaguL96 | 802 | asCfsuugAfaugcugaGfaAfauacuscsc | 1161 | GGAGUAUUUCUCAGCAUUCAAGC | 1520 |
| AD-1136041.2 | gsusauuuCfuCfAfGfcauucaagcuL96 | 803 | asGfscudTg(Agn)augcugAfgAfaauacsusc | 1162 | GAGUAUUUCUCAGCAUUCAAGCA | 1521 |
| AD-1297612.1 | usasuuucUfcAfGfCfauucaagcauL96 | 2071 | asUfsgcdTu(G2p)aaugcuGfaGfaaauascsu | 2195 | AGUAUUUCUCAGCAUUCAAGCAG | 2319 |
| AD-1297613.1 | asusuucuCfaGfCfAfuucaagcaguL96 | 2072 | asCfsugcUfugaaugcUfgAfgaaausasc | 2196 | GUAUUUCUCAGCAUUCAAGCAGG | 2320 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
| --- | --- | --- | --- | --- | --- | --- |
| AD-1297614.1 | ususucucAfgCfAfUfucaagcagguL96 | 2073 | asCfscudGc(Tgn)ugaaugCfuGfagaaasusa | 2197 | UAUUUCUCAGCAUUCAAGCAGGC | 2321 |
| AD-1297615.1 | ususucucaGfcAfUfUfcaagcaggcuL96 | 2074 | asGfsccdTg(C2p)uugaauGfcUfugaaasasu | 2198 | AUUUCUCAGCAUUCAAGCAGGCC | 2322 |
| AD-1297616.1 | uscsucagCfaUfUfCfaagcaggccuL96 | 2075 | asGfsgcdCu(G2p)cuugaaUfgCfugagasasa | 2199 | UUUCUCAGCAUUCAAGCAGGCCU | 2323 |
| AD-1297617.1 | csuscagcAfuUfUfCfAfagcaggccuuL96 | 2076 | asAfsggdCc(Tgn)gcuugaAfuGfcugagsasa | 2200 | UUCUCAGCAUUCAAGCAGGCCUC | 2324 |
| AD-1297618.1 | uscsagcaUfuCfAfAfgcaggccucuL96 | 2077 | asGfsagdGc(C2p)ugcuugAfaUfgcugasgsa | 2201 | UCUCAGCAUUCAAGCAGGCCUCC | 2325 |
| AD-1297619.1 | csasgcauUfcAfAfGfcaggccucccL96 | 2078 | asGfsgadGg(C2p)cugcuuGfaAfugcugsasg | 2202 | CUCAGCAUUCAAGCAGGCCUCCC | 2326 |
| AD-1297620.1 | asasgaagGfuUfCfCfagggguuuguuL96 | 2079 | asAfscaaAfcccuggaAfcCfuucuusasg | 2203 | CUAAGAAGGUUCCAGGGUUUGUU | 2327 |
| AD-1297621.1 | asgsaaggUfuCfCfAfggguuuguuuL96 | 2080 | asAfsacaAfacccuggAfaCfcuucususa | 2204 | UAAGAAGGUUCCAGGGUUUGUUU | 2328 |
| AD-1297622.1 | gsasagguUfcCfAfGfgguuuguuuuL96 | 2081 | asAfsaacAfaacccugGfaAfccuucsusu | 2205 | AAGAAGGUUCCAGGGUUUGUUUG | 2329 |
| AD-1297623.1 | asasgguuCfcAfGfGfguuuguuuguL96 | 2082 | asCfsaaaCfaaacccuGfgAfaccuuscsu | 2206 | AGAAGGUUCCAGGGUUUGUUUGU | 2330 |
| AD-1297624.1 | asgsguucCfaGfGfGfuuuguuuguuL96 | 2083 | asAfscaaAfcaaacccUfgGfaaccususc | 2207 | GAAGGUUCCAGGGUUUGUUUGUU | 2331 |
| AD-1297625.1 | gsgsuuccAfgGfGfUfuuguuuguuuL96 | 2084 | asAfsacaAfacaaaccCfuGfgaaccsusu | 2208 | AAGGUUCCAGGGUUUGUUUGUUU | 2332 |
| AD-1297626.1 | gsusuccaGfgGfUfUfuguuuguuuuL96 | 2085 | asAfsaacAfaacaaacCfcUfggaacscsu | 2209 | AGGUUCCAGGGUUUGUUUGUUUC | 2333 |
| AD-1136050.2 | ususccagGfgUfUfUfguuuguuucuL96 | 812 | asGfsaaaCfaaacaaaCfcCfuggaascsc | 1171 | GGUUCCAGGGUUUGUUUGUUUCA | 1530 |
| AD-1297627.1 | uscscaggGfuUfUfGfuuuguuucauL96 | 2086 | asUfsgaaAfcaaacaaAfcCfcuggasasc | 2210 | GUUCCAGGGUUUGUUUGUUUCAU | 2334 |
| AD-1297628.1 | cscsagggUfuUfGfUfuuguuucauuL96 | 2087 | asAfsugaAfacaaacaAfaCfccuggsasa | 2211 | UUCCAGGGUUUGUUUGUUUCAUU | 2335 |
| AD-1136051.2 | csasggguUfuGfUfUfuguuucauuuL96 | 813 | asAfsaugAfaacaaacAfaAfcccugsgsa | 1172 | UCCAGGGUUUGUUUGUUUCAUUU | 1531 |
| AD-1136052.2 | gsgsuuuGfuUfUfGfuuucauuucuL96 | 814 | asGfsaaaUfgaaacaaAfcAfaacccsusg | 1173 | CAGGGUUUGUUUGUUUCAUUUCC | 1532 |
| AD-1136053.2 | gsgsuuugUfuUfGfUfuucauuuccuL96 | 815 | asGfsgaaAfugaaacaAfaCfaaaccscsu | 1174 | AGGGUUUGUUUGUUUCAUUUCCG | 1533 |
| AD-1297629.1 | gsusuuguUfuGfUfUfucauuuccguL96 | 2088 | asCfsggaAfaugaaaCfaAfacaaascsc | 2212 | GGGUUUGUUUGUUUCAUUUCCGC | 2336 |
| AD-1297630.1 | usususguuUfgUfUfUfcauuuccgcuL96 | 2089 | asGfscggAfaaugaaaCfaAfacaaascsc | 2213 | GGUUUGUUUGUUUCAUUUCCGCU | 2337 |
| AD-1136054.2 | ususguuuGfuUfUfUfCfauuuccgcuuL96 | 816 | asAfsgcgGfaaaugaaAfcAfaacaasasc | 1175 | GUUUGUUUGUUUCAUUUCCGCUG | 1534 |
| AD-1297631.1 | usgsuuugUfuUfCfAfuuuccgcuguL96 | 2090 | asCfsagcGfgaaaugaAfaCfaaacasasa | 2214 | UUUGUUUGUUUCAUUUCCGCUGA | 2338 |
| AD-1297632.1 | gsusuugUfuUfCfAfUfuuccgcugauL96 | 2091 | asUfscadGc(G2p)gaaaugAfaAfcaaacsasa | 2215 | UUGUUUGUUUCAUUUCCGCUGAU | 2339 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
| --- | --- | --- | --- | --- | --- | --- |
| AD-1297633.1 | ususuguuUfcAfUfUfuccgcugauuL96 | 2092 | asAfsucdAg(C2p)ggaaauGfaAfacaaascsa | 2216 | UGUUUGUUUCAUUUCCGCUGAUG | 2340 |
| AD-1297634.1 | ususguuuCfaUfUfUfccgcugauguL96 | 2093 | asCfsaudCa(G2p)cggaaaUfgAfaacaasasc | 2217 | GUUUGUUUCAUUUCCGCUGAUGA | 2341 |
| AD-1297635.1 | usgsuucAfuUfUfCfcgcugaugauL96 | 2094 | asUfscadTc(Agn)gcggaaAfuGfaaacasasa | 2218 | UUUGUUUCAUUUCCGCUGAUGAU | 2342 |
| AD-1297636.1 | gsusuucaUfuUfCfCfgcugaugauuL96 | 2095 | asAfsucdAu(C2p)agcggaAfaUfgaaacsasa | 2219 | UUGUUUCAUUUCCGCUGAUGAUG | 2343 |
| AD-1297637.1 | ususucauUfuCfCfGfcugaugauguL96 | 2096 | asCfsaucAfucagcggAfaAfugaaaascsa | 2220 | UGUUUCAUUUCCGCUGAUGAUGU | 2344 |
| AD-1297638.1 | gsgsagauGfgAfGfCfucuuuguguuL96 | 2097 | asAfscacAfaagagcuCfcAfucuccscsc | 2221 | GGGGAGAUGGAGCUCUUUGUGUC | 2345 |
| AD-1297639.1 | gsasgaugGfaGfCfUfcuuuguguсuL96 | 2098 | asGfsacaCfaaagagcUfcCfaucucscsc | 2222 | GGGAGAUGGAGCUCUUUGUGUCU | 2346 |
| AD-1297640.1 | asgsauggAfgCfUfCfuuuguguсuuL96 | 2099 | asAfsgadCa(C2p)aaagagCfuCfcaucuscsc | 2223 | GGAGAUGGAGCUCUUUGUGUCUA | 2347 |
| AD-1297641.1 | gsasuggaGfcUfCfUfuuuguguсuaL96 | 2100 | asUfsagdAc(Agn)caaagaGfcUfccaucsusc | 2224 | GAGAUGGAGCUCUUUGUGUCUAC | 2348 |
| AD-1297642.1 | asusggagCfuCfUfUfugugucuacuL96 | 2101 | asGfsuadGa(C2p)acaaagAfgCfuccauscsu | 2225 | AGAUGGAGCUCUUUGUGUCUACA | 2349 |
| AD-1297643.1 | usgsgagcUfcUfUfUfgugucuacauL96 | 2102 | asUfsgudAg(Agn)cacaaaGfaGfcuccasusc | 2226 | GAUGGAGCUCUUUGUGUCUACAC | 2350 |
| AD-1297644.1 | gsgsagcuCfuUfUfGfugucuacacuL96 | 2103 | asGfsugdTa(G2p)acacaaAfgAfgcucсsasu | 2227 | AUGGAGCUCUUUGUGUCUACACA | 2351 |
| AD-1297645.1 | gsasgcucUfuUfGfUfgucuacacauL96 | 2104 | asUfsgudGu(Agn)gacacaAfaGfagcucscsa | 2228 | UGGAGCUCUUUGUGUCUACACAG | 2352 |
| AD-1136073.2 | asgscucuUfuGfUfGfucuacacaguL96 | 835 | asCfsugdTg(Tgn)agacacAfaAfgagcuscsc | 1194 | GGAGCUCUUUGUGUCUACACAGA | 1553 |
| AD-1136074.2 | gscsucuuUfgUfGfUfcuacacagauL96 | 836 | asUfscudGu(G2p)uagacaCfaAfagagcsusc | 1195 | GAGCUCUUUGUGUCUACACAGAA | 1554 |
| AD-1136075.2 | csuscuuuGfuGfUfCfuacacagaauL96 | 837 | asUfsucdTg(Tgn)guagacAfcAfaagagscsu | 1196 | AGCUCUUUGUGUCUACACAGAAC | 1555 |
| AD-1136076.2 | uscsuuugUfgUfCfUfacacagaacuL96 | 838 | asGfsuudCu(G2p)uuagacCfaCfaaagasgsc | 1197 | GCUCUUUGUGUCUACACAGAACA | 1556 |
| AD-1136077.2 | csusuuguGfuCfUfAfcacagaacauL96 | 839 | asUfsgudTc(Tgn)guuagAfcCfaaagsasg | 1198 | CUCUUUGUGUCUACACAGAACAC | 1557 |
| AD-1136078.2 | ususugugUfcUfAfCfacagaacacuL96 | 840 | asGfsugdTu(C2p)uguaGfaCfacaaasgsa | 1199 | UCUUUGUGUCUACACAGAACACC | 1558 |
| AD-1297646.1 | ususugucCfuAfCfAfcagaacaccuL96 | 2105 | asGfsugdGu(Tgn)cuguAfgAfcacaasasg | 2229 | CUUUGUGUCUACACAGAACACCA | 2353 |
| AD-1297647.1 | usgsugucUfaCfAfCfagaacaccauL96 | 2106 | asUfsggdTg(Tgn)ucugUfaGfacacasasa | 2230 | UUUGUGUCUACACAGAACACCAU | 2354 |
| AD-1297648.1 | gsusgucuAfcAfCfAfgaacaccauuL96 | 2107 | asAfsugdGu(G2p)uucuGfuGfacacsasa | 2231 | UUGUGUCUACACAGAACACCAUG | 2355 |
| AD-1297649.1 | usgsucuaCfaCfAfGfaacaccauguL96 | 2108 | asCfsaudGg(Tgn)guucugUfgUfagacascsa | 2232 | UGUGUCUACACAGAACACCAUGA | 2356 |
| AD-1297650.1 | gsuscuacAfcAfGfAfacaccaugauL96 | 2109 | asUfscadTg(G2p)uguucuGfuGfuagacsasc | 2233 | GUGUCUACACAGAACACCAUGAA | 2357 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1297651.1 | uscsuacaCfaGfAfAfcaccaugaauL96 | 2110 | asUfsucdAu(G2p)guguucUfgUfguagascsa | 2234 | UGUCUACACAGAACACCAUGAAG | 2358 |
| AD-1297652.1 | csusacacAfgAfAfCfaccaugaaguL96 | 2111 | asCfsuucAfugguguuCfuGfuguagsasc | 2235 | GUCUACACAGAACACCAUGAAGA | 2359 |
| AD-1297653.1 | usascacaGfaAfCfAfccaugaagauL96 | 2112 | asUfscudTc(Agn)uggugUfcUfguguasgsa | 2236 | UCUACACAGAACACCAUGAAGAC | 2360 |
| AD-1297654.1 | gsgsgaacAfcCfCfAfggaucucucuL96 | 2113 | asGfsagdAg(Agn)uccuggGfuGfuucccscsa | 2237 | UGGGGAACACCCAGGAUCUCUCU | 2361 |
| AD-1297655.1 | gsgsaacaCfcCfAfGfgaucucucuuL96 | 2114 | asAfsgadGa(G2p)auccugGfgUfguuccscsc | 2238 | GGGGAACACCCAGGAUCUCUCUC | 2362 |
| AD-1297656.1 | gsasacacCfcAfGfGfaucucucucuL96 | 2115 | asGfsagdAg(Agn)gauccuGfgGfuguucscsc | 2239 | GGGAACACCCAGGAUCUCUCUCA | 2363 |
| AD-1297657.1 | asascaccCfaGfGfAfucucucucauL96 | 2116 | asUfsgadGa(G2p)agauccUfgGfguguuscsc | 2240 | GGAACACCCAGGAUCUCUCUCAG | 2364 |
| AD-1297658.1 | ascsacccAfgGfAfUfcucucucaguL96 | 2117 | asCfsugaGfagagaucCfuGfggugususc | 2241 | GAACACCCAGGAUCUCUCUCAGA | 2365 |
| AD-1297659.1 | csasccccaGfgAfUfCfucucucagauL96 | 2118 | asUfscudGa(G2p)agagauCfcUfgggugsusu | 2242 | AACACCCAGGAUCUCUCAGAG | 2366 |
| AD-1297660.1 | ascsccagGfaUfCfUfcucucagauL96 | 2119 | asCfsucdTg(Agn)gagagaUfcCfugggusgsu | 2243 | ACACCCAGGAUCUCUCAGAGU | 2367 |
| AD-1297661.1 | cscscaggAfuCfUfCfucucagaguuL96 | 2120 | asAfscudCu(G2p)agagagAfuCfcugggsusg | 2244 | CACCCAGGAUCUCUCAGAGUA | 2368 |
| AD-1297662.1 | cscsaggaUfcUfCfUfcucagaguauL96 | 2121 | asUfsacdTc(Tgn)gagagaGfaUfccuggsgsu | 2245 | ACCCAGGAUCUCUCAGAGUAU | 2369 |
| AD-1297663.1 | csasggauCfuCfUfCfucagaguauuL96 | 2122 | asAfsuadCu(C2p)ugagagAfgAfuccugsgsg | 2246 | CCCAGGAUCUCUCAGAGUAUU | 2370 |
| AD-1136082.2 | asgsgaucUfcUfCfUfcagaguauuuL96 | 844 | asAfsaudAc(Tgn)cugagaGfaGfauccusgsg | 1203 | CCAGGAUCUCUCAGAGUAUUA | 1562 |
| AD-1136083.2 | gsgsaucuCfuCfUfCfagaguauuauL96 | 845 | asUfsaadTa(C2p)ucugagAfgAfgauccsusg | 1204 | CAGGAUCUCUCAGAGUAUUAU | 1563 |
| AD-1136084.2 | gsasucucUfcUfCfAfgaguauuauuL96 | 846 | asAfsuaaUfacucugaGfaGfagaucscsu | 1205 | AGGAUCUCUCAGAGUAUUAUG | 1564 |
| AD-1136085.2 | asusucucCfuCfAfGfaguauuaguL96 | 847 | asCfsauaAfuacucugAfgAfgagauscsc | 1206 | GGAUCUCUCAGAGUAUUAUGG | 1565 |
| AD-1136086.2 | uscsucucUfcAfGfAfguauuagguL96 | 848 | asCfscauAfauacucuGfaGfagagasusc | 1207 | GAUCUCUCAGAGUAUUAUGGA | 1566 |
| AD-1136087.2 | csuscucuCfaGfAfGfuauuauggauL96 | 849 | asUfsccaUfaauacucUfgAfgagagsasu | 1208 | AUCUCUCAGAGUAUUAUGGAA | 1567 |
| AD-1136088.2 | uscsucucAfgAfGfUfauuauggaauL96 | 850 | asUfsccAfuaaucuCfuGfagagasgsa | 1209 | UCUCUCAGAGUAUUAUGGAAC | 1568 |
| AD-1136089.2 | csuscucaGfaGfUfAfuuauggaacuL96 | 851 | asGfsuudCc(Agn)uaauacUfcUfgagagsasg | 1210 | CUCUCAGAGUAUUAUGGAACG | 1569 |
| AD-1136090.2 | uscsucagAfgUfAfUfuauggaacguL96 | 852 | asCfsguuCfcauaauaCfuCfugagagsasg | 1211 | UCUCAGAGUAUUAUGGAACGA | 1570 |
| AD-1297664.1 | csuscagaGfuAfUfUfauggaacgauL96 | 2123 | asUfscgdTu(C2p)cauaauAfcUfcugagsasg | 2247 | CUCUCAGAGUAUUAUGGAACGAG | 2371 |
| AD-1136091.2 | uscsagagUfaUfUfAfuggaacgaguL96 | 853 | asCfsucgUfuccauaaUfaCfucugasgsa | 1212 | UCUCAGAGUAUUAUGGAACGAGC | 1571 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136092.2 | csasgaguAfuUfAfUfggaacgagcuL96 | 854 | asGfscucGfuuccauaAfuAfcucugsasg | 1213 | CUCAGAGUAUUAUGGAACGAGCU | 1572 |
| AD-1297665.1 | asgsaguaUfuAfUfGfgaacgagcuuL96 | 2124 | asAfsgcdTc(G2p)uuccauAfaUfacucusgsa | 2248 | UCAGAGUAUUAUGGAACGAGCUU | 2372 |
| AD-1297666.1 | gsasguauUfaUfGfGfaacgagcuuuL96 | 2125 | asAfsagdCu(C2p)guuccaUfaAfuacucsusg | 2249 | CAGAGUAUUAUGGAACGAGCUUU | 2373 |
| AD-1297667.1 | asgsuauuAfuGfGfAfacgagcuuuuL96 | 2126 | asAfsaadGc(Tgn)cguuccAfuAfauacuscsu | 2250 | AGAGUAUUAUGGAACGAGCUUUA | 2374 |
| AD-1297668.1 | gsusauuaUfgGfAfAfcgagcuuuauL96 | 2127 | asUfsaadAg(C2p)ucguucCfaUfaauacsusc | 2251 | GAGUAUUAUGGAACGAGCUUUAU | 2375 |
| AD-1297669.1 | usasuauaGfgAfAfCfgagcuuuauuL96 | 2128 | asAfsuadAa(G2p)cucguuCfcCfauaauascsu | 2252 | AGUAUUAUGGAACGAGCUUUAUU | 2376 |
| AD-1297670.1 | asusuaugGfaAfCfGfagcuuuauuuL96 | 2129 | asAfsauaAfagcucguUfcCfauaausasc | 2253 | GUAUUAUGGAACGAGCUUUAUUC | 2377 |
| AD-1297671.1 | ususauggAfaCfGfAfgcuuuauucuL96 | 2130 | asGfsaauAfaagcucgUfuCfcauaasusa | 2254 | UAUUAUGGAACGAGCUUUAUUC | 2378 |
| AD-1297672.1 | usasuggaAfcGfAfGfcuuuauuccuL96 | 2131 | asGfsgaaUfaaagcucGfuUfccauasasu | 2255 | AUUAUGGAACGAGCUUUAUUCCA | 2379 |
| AD-1297673.1 | csuscuucCfuGfGfCfugcuucuauuL96 | 2132 | asAfsuagAfagcagccAfgGfaagagsgsg | 2256 | CCCUCUUCCUGGCUGCUUCUAUC | 2380 |
| AD-1297674.1 | uscsuuccUfgGfCfUfgcuucuaucuL96 | 2133 | asGfsaudAg(Agn)agcagcCfaGfgaagasgsg | 2257 | CCUCUUCCUGGCUGCUUCUAUCU | 2381 |
| AD-1297675.1 | csusuccuGfgCfUfGfcuucuaucuuL96 | 2134 | asAfsgauAfgaagcagCfcAfggaagsasg | 2258 | CUCUUCCUGGCUGCUUCUAUCUU | 2382 |
| AD-1136159.2 | ususccugGfcUfGfCfuucuaucuuuL96 | 920 | asAfsagaUfagaagcaGfcCfaggaasgsa | 1279 | UCUUCCUGGCUGCUUCUAUCUUC | 1638 |
| AD-1136160.2 | uscscuggCfuGfCfUfucuaucuucuL96 | 921 | asGfsaagAfuagaagcAfgCfcaggasasg | 1280 | CUUCCUGGCUGCUUCUAUCUUCU | 1639 |
| AD-1136161.2 | cscsuggcUfgCfUfUfcuaucuucuuL96 | 922 | asAfsgaaGfauagaagCfaGfccaggsasa | 1281 | UUCCUGGCUGCUUCUAUCUUCUU | 1640 |
| AD-1136162.2 | csusggcuGfcUfUfCfuaucuucuuuL96 | 923 | asAfsagaAfgauagaaGfcAfgccagsgsa | 1282 | UCCUGGCUGCUUCUAUCUUCUUU | 1641 |
| AD-1136163.2 | usgsgcugCfuUfCfUfaucuucuuuuL96 | 924 | asAfsaagAfagauagaAfgCfagccasgsg | 1283 | CCUGGCUGCUUCUAUCUUCUUUG | 1642 |
| AD-1297676.1 | gsgscugcUfuCfUfUfAfucuucuuuguL96 | 2135 | asCfsaaaGfaagauagAfaGfcagccsasg | 2259 | CUGGCUGCUUCUAUCUUCUUUGC | 2383 |
| AD-1136164.2 | gscsugcuUfcUfAfUfcuucuuugcuL96 | 925 | asGfscaaAfgaagauaGfaAfgcagcscsa | 1284 | UGGCUGCUUCUAUCUUCUUUGCC | 1643 |
| AD-1136165.2 | csusgcuuCfuAfUfCfuucuuugccuL96 | 926 | asGfsgcaAfagaagauAfgAfagcagscsc | 1285 | GGCUGCUUCUAUCUUCUUUGCCA | 1644 |
| AD-1136166.2 | usgscuucUfaUfCfUfucuuugccauL96 | 927 | asUfsggdCa(Agn)agaagaUfaGfaagcasgsc | 1286 | GCUGCUUCUAUCUUCUUUGCCAU | 1645 |
| AD-1136167.2 | gscsucuAfuCfUfUfcuuugccauuL96 | 928 | asAfsugdGc(Agn)aagaagAfuAfgaagcsasg | 1287 | CUGCUUCUAUCUUCUUUGCCAUC | 1646 |
| AD-1136168.2 | csuscuaUfcUfUfCfuuugccaucuL96 | 929 | asGfsaudGg(C2p)aaagaaGfaUfagaagscsa | 1288 | UGCUUCUAUCUUCUUUGCCAUCA | 1647 |
| AD-1136169.2 | ususcuauCfuUfCfUfuugccaucauL96 | 930 | asUfsgadTg(G2p)caaagaAfgAfuagaasgsc | 1289 | GCUUCUAUCUUCUUUGCCAUCAA | 1648 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1136170.2 | uscsuaucUfuCfUfUfugccaucaauL96 | 931 | asUfsugdAu(G2p)gcaaagAfaGfauaga sasg | 1290 | CUUCUAUCUUCU UUGCCAUCAAA | 1649 |
| AD-1136171.2 | csusaucuUfcUfUfUfgccaucaaauL96 | 932 | asUfsuudGa(Tgn)ggcaaaGfaAfgauag sasa | 1291 | UUCUAUCUUCUU UGCCAUCAAAG | 1650 |
| AD-1136172.2 | usasucuuCfuUfUfGfccaucaaaguL96 | 933 | asCfsuuuGfauggcaaAfgAfagauasgsa | 1292 | UCUAUCUUCUUU GCCAUCAAAGA | 1651 |
| AD-1136173.2 | asuscuucUfuUfGfCfcaucaaagauL96 | 934 | asUfscudTu(G2p)auggcaAfaGfaagau sasg | 1293 | CUAUCUUCUUUG UCCAUCAAAGA | 1652 |
| AD-1297677.1 | uscsuucuUfuGfCfCfaucaaagauuL96 | 2136 | asAfsucuUfugauggcAfaAfgaagasusa | 2260 | UAUCUUCUUUGC CAUCAAAGAUG | 2384 |
| AD-1136174.2 | csusucuuUfgCfCfAfucaaagauguL96 | 935 | asCfsaucUfuugauggCfaAfagaagsasu | 1294 | AUCUUCUUUGCC AUCAAAGAUGC | 1653 |
| AD-1297678.1 | ususcuuuGfcCfAfUfcaaagaugcuL96 | 2137 | asGfscadTc(Tgn)uugaugGfcAfaagaa sgsa | 2261 | UCUUCUUUGCCA UCAAAGAUGCC | 2385 |
| AD-1297679.1 | uscsuuugCfcAfUfCfaaagaugccuL96 | 2138 | asGfsgcdAu(C2p)uuugauGfgCfaaaga sasg | 2262 | CUUCUUUGCCAU CAAAGAUGCCA | 2386 |
| AD-1297680.1 | csusuugcCfaUfCfAfaagaugccauL96 | 2139 | asUfsggdCa(Tgn)cuugaUfgGfcaaag sasa | 2263 | UUCUUUGCCAUC AAAGAUGCCA | 2387 |
| AD-1297681.1 | ususugccAfuCfAfAfagaugccauuL96 | 2140 | asAfsugdGc(Agn)ucuugAfuGfgcaaa sgsa | 2264 | UCUUUGCCAUCA AAGAUGCAUC | 2388 |
| AD-1297682.1 | ususgccaUfcAfAfAfgaugccaucuL96 | 2141 | asGfsaudGg(C2p)aucuuGfaUfggcaa sasg | 2265 | CUUUGCCAUCAA AGAUGCCAUCC | 2389 |
| AD-1297683.1 | usgsccauCfaAfAfAfgaugccauccuL96 | 2142 | asGfsgadTg(G2p)caucuuUfgAfuggca sasa | 2266 | UUUGCCAUCAAA GAUGCCAUCCG | 2390 |
| AD-1297684.1 | gscscaucAfaAfGfAfugccauccguL96 | 2143 | asCfsggaUfggcaucuUfuGfauggcsasa | 2267 | UUGCCAUCAAAG AUGCCAUCCG | 2391 |
| AD-1297685.1 | asasaccaAfuGfAfAfcagcaaagcuL96 | 2144 | asGfscudTu(G2p)cuguucAfuUfgguuu sgsa | 2268 | UCAAACCAAUGA ACAGCAAAGCA | 2392 |
| AD-1297686.1 | asasccaaUfgAfAfCfagcaaagcauL96 | 2145 | asUfsgcdTu(Tgn)gcuguuCfaUfugguu susg | 2269 | CAAACCAAUGAA CAGCAAAGCAU | 2393 |
| AD-1297687.1 | ascscaauGfaAfCfAfgcaaagcauuL96 | 2146 | asAfsugdCu(Tgn)ugcuguUfcAfuuggu susu | 2270 | AAACCAAUGAAC AGCAAAGCAUA | 2394 |
| AD-1297688.1 | cscsaaugAfaCfAfGfcaaagcauauL96 | 2147 | asUfsaudGc(Tgn)uugcugUfuCfauugg susu | 2271 | AACCAAUGAACA GCAAAGCAUAA | 2395 |
| AD-1297689.1 | csasaugaAfcAfGfCfaaagcauaauL96 | 2148 | asUfsuadTg(C2p)uuugcuGfuUfcauug sgsu | 2272 | ACCAAUGAACAG CAAAGCAUAAC | 2396 |
| AD-1297690.1 | asasaugaaCfaGfCfAfaagcauaacuL96 | 2149 | asGfsuudAu(G2p)cuuugcUfgGfucauu sgsg | 2273 | CCAAUGAACAGC AAAGCAUAACC | 2397 |
| AD-1297691.1 | asusugaacAfgCfAfAfagcauaaccuL96 | 2150 | asGfsgudTa(Tgn)gcuuugCfuGfuucau susg | 2274 | CAAUGAACAGCA AAGCAUAACCU | 2398 |
| AD-1297692.1 | usgsaacaGfcAfAfAfgcauaaccuuL96 | 2151 | asAfsgguUfaugcuuuGfcUfguucasusu | 2275 | AAUGAACAGCAA AGCAUAACCUU | 2399 |
| AD-1136221.2 | gsasacagCfaAfAfGfcauaaccuuuL96 | 982 | asAfsaggUfuaugcuuUfgCfguucsasu | 1341 | AUGAACAGCAAA GCAUAACCUUG | 1700 |
| AD-1136222.2 | asascagcAfaAfGfCfauaaccuuguL96 | 983 | asCfsaadGg(Tgn)uaugcuUfuGfucuuu scsa | 1342 | UGAACAGCAAAG CAUAACCUUGA | 1701 |
| AD-1297693.1 | ascsagcaAfaGfCfAfuaaccuugauL96 | 2152 | asUfscadAg(G2p)uuaugcUfuUfgcugu susc | 2276 | GAACAGCAAAGC AUAACCUUGAA | 2400 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1297694.1 | csasgcaaAfgCfAfUfaaccuugaauL96 | 2153 | asUfsucdAa(G2p)guuaugCfuUfugcugsusu | 2277 | AACAGCAAAGCAUAACCUUGAAU | 2401 |
| AD-1136223.2 | asgscaaaGfcAfUfAfaccuugaauuL96 | 984 | asAfsuucAfagguuauGfcUfuugcusgsu | 1343 | ACAGCAAAGCAUAACCUUGAAUC | 1702 |
| AD-1136224.2 | gscsaaagCfaUfAfAfccuugaaucuL96 | 985 | asGfsaudTc(Agn)agguuaUfgCfuuugcsusg | 1344 | CAGCAAAGCAUAACCUUGAAUCU | 1703 |
| AD-1136225.2 | csasaagcAfuUfAfAfCfcuugaaucuuL96 | 986 | asAfsgadTu(C2p)aagguuAfuGfcuuugscsu | 1345 | AGCAAAGCAUAACCUUGAAUCUA | 1704 |
| AD-1297695.1 | asasagcaUfaAfCfCfuugaaucuauL96 | 2154 | asUfsagdAu(Tgn)caagguUfaUfgcuuusgsc | 2278 | GCAAAGCAUAACCUUGAAUCUAU | 2402 |
| AD-1297696.1 | asasgcauAfaCfCfUfugaaucuauuL96 | 2155 | asAfsuagAfuucaaggUfuAfugcuususg | 2279 | CAAAGCAUAACCUUGAAUCUAUA | 2403 |
| AD-1297697.1 | asgscauaAfcCfUfUfgaaucuauauL96 | 2156 | asUfsaudAg(Agn)uucaagGfuUfaugcususu | 2280 | AAAGCAUAACCUUGAAUCUAUAC | 2404 |
| AD-1136226.2 | gscsauaaCfcUfUfGfaaucuauacuL96 | 987 | asGfsuauAfgauucaaGfgUfuaugcsusu | 1346 | AAGCAUAACCUUGAAUCUAUACU | 1705 |
| AD-1136227.2 | csasuaacCfuUfGfAfaucuauacuuL96 | 988 | asAfsguaUfagauucaAfgGfuuaugscsu | 1347 | AGCAUAACCUUGAAUCUAUACUC | 1706 |
| AD-1136228.2 | asusaaccUfuGfAfAfucuauacucuL96 | 989 | asGfsaguAfuagauucAfaGfguuausgsc | 1348 | GCAUAACCUUGAAUCUAUACUCA | 1707 |
| AD-1136229.2 | usasaccuUfgAfAfUfcuauacucauL96 | 990 | asUfsgadGu(Agn)uagauuCfaAfgguuasusg | 1349 | CAUAACCUUGAAUCUAUACUCAA | 1708 |
| AD-1136230.2 | asasccuuGfaAfUfCfuauacucaauL96 | 991 | asUfsugdAg(Tgn)auagauUfcAfagguusasu | 1350 | AUAACCUUGAAUCUAUACUCAAA | 1709 |
| AD-1136231.2 | ascscuugAfaUfCfUfauacucaaauL96 | 992 | asUfsuudGa(G2p)uauagaUfuCfaaggususa | 1351 | UAACCUUGAAUCUAUACUCAAAU | 1710 |
| AD-1136232.2 | cscsuugaAfuCfUfAfuacucaaauuL96 | 993 | asAfsuudTg(Agn)guauagAfuUfcaaggsusu | 1352 | AACCUUGAAUCUAUACUCAAAUU | 1711 |
| AD-1297698.1 | csusugaaUfcUfAfUfacucaaauuuL96 | 2157 | asAfsaudTu(G2p)aguauaGfaUfucaagsgsu | 2281 | ACCUUGAAUCUAUACUCAAAUUU | 2405 |
| AD-1297699.1 | ususgaauCfuAfUfAfcucaaauuuuL96 | 2158 | asAfsaauUfugaguauAfgAfuucaasgsg | 2282 | CCUUGAAUCUAUACUCAAAUUUU | 2406 |
| AD-1297700.1 | gsasaucuAfuAfCfUfcaaauuuguL96 | 2159 | asCfsaaaAfuuugaguAfuAfgauucsasa | 2283 | UUGAAUCUAUACUCAAAUUUGC | 2407 |
| AD-1136233.2 | asasucuaUfaCfUfCfaaauuugcuL96 | 994 | asGfscaaAfauuugagUfaUfagauuscsa | 1353 | UGAAUCUAUACUCAAAUUUGCA | 1712 |
| AD-1136234.2 | asuscuauAfcUfCfAfaauuugcauL96 | 995 | asUfsgcaAfaauuugaGfuAfuagaususc | 1354 | GAAUCUAUACUCAAAUUUGCAA | 1713 |
| AD-1297701.1 | uscsuauaCfuCfAfAfauuugcaauL96 | 2160 | asUfsugcAfaauuugAfgUfauagasusu | 2284 | AAUCUAUACUCAAAUUUGCAAU | 2408 |
| AD-1297702.1 | csusauacUfcAfAfAfuuugcaauuL96 | 2161 | asAfsuudGc(Agn)aaauuuGfaGfuauagsasu | 2285 | AUCUAUACUCAAAUUUGCAAUG | 2409 |
| AD-1297703.1 | usasuacuCfaAfAfUfuuugcaauguL96 | 2162 | asCfsaudTg(C2p)aaauuuUfgAfguauasgsa | 2286 | UCUAUACUCAAAUUUUGCAAUGA | 2410 |
| AD-1297704.1 | asusacucAfaAfUfUfuugcaaugauL96 | 2163 | asUfscadTu(G2p)caaaauUfuGfaguausasg | 2287 | CUAUACUCAAAUUUGCAAUGAG | 2411 |
| AD-1297705.1 | usascucaAfaUfUfUfugcaaugaguL96 | 2164 | asCfsucaUfugcaaaaUfuUfgaguasusa | 2288 | UAUACUCAAAUUUUGCAAUGAGG | 2412 |

TABLE 7-continued

Modified Sense and Antisense Strand Sequences of Xanthine Dehydrogenase dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1297706.1 | ascsucaaAfuUfUfUfgcaaugagguL96 | 2165 | asCfscucAfuugcaaaAfuUfugagusasu | 2289 | AUACUCAAAUUU UGCAAUGAGGC | 2413 |
| AD-1297707.1 | csuscaaaUfuUfUfGfcaaugaggcuL96 | 2166 | asGfsccdTc(Agn)uugcaaAfaUfuugag susa | 2290 | UACUCAAAUUUU GCAAUGAGGCA | 2414 |
| AD-1297708.1 | uscsaaauUfuUfGfCfaaugaggcauL96 | 2167 | asUfsgcdCu(C2p)auugcaAfaAfuuuga sgsu | 2291 | ACUCAAAUUUUG CAAUGAGGCAG | 2415 |
| AD-1297709.1 | csasaauuUfuGfCfAfaugaggcaguL96 | 2168 | asCfsugdCc(Tgn)cauugcAfaAfauuug sasg | 2292 | CUCAAAUUUGC AAUGAGGCAGU | 2416 |
| AD-1297710.1 | asasauuuUfgCfAfAfugaggcaguuL96 | 2169 | asAfscudGc(C2p)ucauugCfaAfaauuu sgsa | 2293 | UCAAAUUUUGCA AUGAGGCAGUG | 2417 |
| AD-1297711.1 | asasuuuuGfcAfAfUfgaggcaguguL96 | 2170 | asCfsacdTg(C2p)cucauuGfcAfaaauu susg | 2294 | CAAAUUUUGCAA UGAGGCAGUGG | 2418 |
| AD-1297712.1 | asusuuugCfaAfUfGfaggcaguggL96 | 2171 | asCfscacUfgccucauUfgCfaaaaususu | 2295 | AAAUUUUGCAAU GAGGCAGUGGG | 2419 |
| AD-1395794.1 | csuscuccaagUfAfUfgaucgucuuL96 | 2172 | asdAsgadCgdAucaudAcUfggagagscs g | 2296 | UGCUCUCCAAGU GAUGAUCGUCU | 1476 |
| AD-1395797.1 | asgsgaucucUfCfUfcagaguauuuL96 | 2173 | asdAsaudAc(Tgn)cugadGadGadGaucc usgsg | 2297 | CCAGGAUCUCUC UCAGAGUAUUA | 1562 |
| AD-1395803.1 | csasgugaugCfUfCfuccaaguauuL96 | 2174 | asdAsuadCudTggagdAgCfaucacugsus g | 2298 | CACAGUGAUGCU CUCCAAGUAUG | 2305 |
| AD-1395805.1 | cscsaaguauGfAfUfcgucugcaguL96 | 2175 | asdCsugdCadGacgadTcAfuacuuggsas g | 2299 | CUCCAAGUAUGA UCGUCUGCAGA | 2312 |
| AD-1395807.1 | gsusuuguuuCfAfUfuuccgcugauL96 | 2176 | asdTscadGc(G2p)gaaadTgAfaacaaac sgsg | 2300 | UUGUUUGUUUCA UUUUCCGCUGA | 2339 |
| AD-1395811.1 | asascacccaGfGfAfucucucucauL96 | 2177 | asdTsgadGa(G2p)agaudCcUfggguguu scsc | 2301 | GGAACACCCAGG AUCUCUCUCAG | 2364 |
| AD-1395816.1 | gsgsguuuguUfudGUfuucauuucuL96 | 2178 | asdGsaadAudGaaacdAaAfcaaacccsus g | 2302 | CAGGGUUUGUUU GUUUCAUUUCC | 1

TABLE 8-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1297601.1 | 43.3 | 7.9 | 61.2 | 19.4 | 91.8 | 11.2 | 93.9 | 12.0 |
| AD-1135992.2 | 34.0 | 6.5 | 31.7 | 16.9 | 64.5 | 31.3 | 90.8 | 26.9 |
| AD-1135993.2 | 54.4 | 5.9 | 60.8 | 13.9 | 107.4 | 31.0 | 111.3 | 5.6 |
| AD-1135994.2 | 84.8 | 8.6 | 95.6 | 8.2 | 109.1 | 15.8 | 119.7 | 11.0 |
| AD-1135995.2 | 59.0 | 4.3 | 75.2 | 14.3 | 94.9 | 26.1 | 95.8 | 15.0 |
| AD-1135996.2 | 31.1 | 4.3 | 50.8 | 7.1 | 63.5 | 16.7 | 80.2 | 21.7 |
| AD-1297602.1 | 74.7 | 7.3 | 73.2 | 12.7 | 104.5 | 7.3 | 84.3 | 21.0 |
| AD-1297603.1 | 91.4 | 9.7 | 142.7 | 74.0 | 117.3 | 17.7 | 110.9 | 14.0 |
| AD-1297604.1 | 50.1 | 10.9 | 57.4 | 8.8 | 95.0 | 29.8 | 120.8 | 28.8 |
| AD-1297605.1 | 30.8 | 4.7 | 35.7 | 25.5 | 86.0 | 26.2 | 140.8 | 33.5 |
| AD-1297606.1 | 86.7 | 18.6 | 68.4 | 12.6 | 85.1 | 7.2 | 89.8 | 6.6 |
| AD-1297607.1 | 47.3 | 3.0 | 56.6 | 18.7 | 70.1 | 7.6 | 103.3 | 8.5 |
| AD-1297608.1 | 47.2 | 7.7 | 49.6 | 10.5 | 65.7 | 9.5 | 84.7 | 20.3 |
| AD-1297609.1 | 63.2 | 6.4 | 61.0 | 7.5 | 96.6 | 16.7 | 112.8 | 22.7 |
| AD-1297610.1 | 60.3 | 9.7 | 78.9 | 10.5 | 104.7 | 12.3 | 118.0 | 17.4 |
| AD-1297611.1 | 65.7 | 14.9 | 70.0 | 9.6 | 88.0 | 10.6 | 116.1 | 13.8 |
| AD-1136037.2 | 35.8 | 3.7 | 27.7 | 7.9 | 78.2 | 13.9 | 138.3 | 0.0 |
| AD-1136038.2 | 37.6 | 1.1 | 26.3 | 10.8 | 77.8 | 8.7 | 86.1 | 27.4 |
| AD-1136039.2 | 42.2 | 7.7 | 75.4 | 8.1 | 88.3 | 9.9 | 96.2 | 22.8 |
| AD-1136040.2 | 63.0 | 9.8 | 89.8 | 7.8 | 86.4 | 21.0 | 89.9 | 11.6 |
| AD-1136041.2 | 83.0 | 16.4 | 70.0 | 21.5 | 105.9 | 21.4 | 98.7 | 5.0 |
| AD-1297612.1 | 84.2 | 17.1 | 83.6 | 5.9 | 106.2 | 14.6 | 103.2 | 7.8 |
| AD-1297613.1 | 52.7 | 20.3 | 89.6 | 28.1 | 97.3 | 15.1 | 85.6 | 12.9 |
| AD-1297614.1 | 72.6 | 14.9 | 70.6 | 30.7 | 74.5 | 17.3 | 96.5 | 12.5 |
| AD-1297615.1 | 73.9 | 6.0 | 94.3 | 31.6 | 96.2 | 10.0 | 113.8 | 37.2 |
| AD-1297616.1 | 69.5 | 12.7 | 89.8 | 4.4 | 103.9 | 23.4 | 102.4 | 31.5 |
| AD-1297617.1 | 62.5 | 17.7 | 53.4 | 8.0 | 79.5 | 9.8 | 87.2 | 5.8 |
| AD-1297618.1 | 48.2 | 0.0 | 76.0 | 12.7 | 106.7 | 35.5 | 81.6 | 10.8 |
| AD-1297619.1 | 90.3 | 21.9 | 81.4 | 9.4 | 106.3 | 14.9 | 96.6 | 24.9 |
| AD-1297620.1 | 48.1 | 11.5 | 47.7 | 4.6 | 90.3 | 28.9 | 111.2 | 26.6 |
| AD-1297621.1 | 43.9 | 12.6 | 54.0 | 12.5 | 88.6 | 18.3 | 84.4 | 20.6 |
| AD-1297622.1 | 52.2 | 17.4 | 65.1 | 23.1 | 103.5 | 8.3 | 105.1 | 25.5 |
| AD-1297623.1 | 79.5 | 3.9 | 78.2 | 21.8 | 107.4 | 6.1 | 107.4 | 14.9 |
| AD-1297624.1 | 46.9 | 22.9 | 66.8 | 22.5 | 94.6 | 10.2 | 102.2 | 24.4 |

TABLE 8-continued

Xanthine Dehydrogenase dsRNA Agent In Vitro Single Dose Screens in Primary Human Hepatocytes

| | PHH | | | | | | | |
|---|---|---|---|---|---|---|---|---|
| | 500 nM | | 100 nM | | 10 nM | | 0.1 nM | |
| DuplexID | % of Avg Message Remaining | ST DEV | % of Avg Message Remaining | ST DEV | % of Avg Message Remaining | ST DEV | % of Avg Message Remaining | ST DEV |
| AD-1297625.1 | 71.6 | 25.9 | 88.4 | 16.0 | 84.4 | 34.9 | 110.2 | 31.1 |
| AD-1297626.1 | 74.1 | 21.9 | 61.7 | 12.1 | 89.4 | 14.6 | 98.4 | 13.2 |
| AD-1136050.2 | 47.9 | 27.7 | 62.8 | 27.3 | 89.2 | 16.2 | 102.8 | 34.7 |
| AD-1297627.1 | 42.7 | 21.0 | 43.9 | 10.8 | 90.9 | 28.5 | 112.4 | 29.7 |
| AD-1297628.1 | 27.2 | 2.8 | 40.3 | 11.7 | 63.8 | 22.0 | 73.5 | 28.0 |
| AD-1136051.2 | 37.4 | 5.3 | 44.9 | 12.0 | 45.0 | 11.8 | 91.8 | 11.6 |
| AD-1136052.2 | 41.2 | 10.0 | 44.4 | 11.2 | 76.3 | 4.5 | 70.5 | 28.6 |
| AD-1136053.2 | 38.7 | 7.0 | 68.6 | 8.4 | 82.4 | 38.3 | 129.7 | 35.5 |
| AD-1297629.1 | 53.8 | 17.9 | 57.9 | 11.7 | 89.1 | 15.3 | 137.6 | 34.8 |
| AD-1297630.1 | 58.7 | 23.3 | 85.6 | 17.4 | 96.6 | 21.8 | 70.5 | 33.0 |
| AD-1136054.2 | 53.3 | 22.5 | 62.8 | 10.3 | 85.7 | 25.7 | 107.7 | 24.2 |
| AD-1297631.1 | 48.2 | 15.8 | 80.4 | 15.6 | 107.1 | 16.3 | 110.5 | 25.1 |
| AD-1297632.1 | 42.1 | 7.2 | 43.0 | 10.0 | 96.2 | 9.7 | 103.3 | 1.0 |
| AD-1297633.1 | 43.2 | 8.9 | 90.4 | 11.0 | 96.5 | 20.0 | 93.0 | 6.0 |
| AD-1297634.1 | 54.6 | 15.4 | 88.7 | 21.6 | 85.9 | 16.7 | 106.6 | 12.6 |
| AD-1297635.1 | 67.7 | 14.5 | 74.6 | 16.9 | 102.2 | 24.8 | 84.7 | 26.6 |
| AD-1297636.1 | 80.8 | 15.9 | 93.2 | 14.2 | 106.6 | 23.4 | 120.7 | 34.7 |
| AD-1297637.1 | 40.7 | 4.8 | 73.3 | 18.4 | 72.2 | 11.8 | 105.2 | 17.1 |
| AD-1297638.1 | 79.9 | 14.7 | 98.6 | 15.9 | 120.9 | 20.9 | 97.7 | 31.5 |
| AD-1297639.1 | 41.6 | 9.7 | 84.5 | 15.6 | 107.2 | 11.6 | 128.2 | 9.5 |
| AD-1297640.1 | 82.8 | 18.5 | 82.7 | 23.1 | 97.3 | 15.4 | 199.9 | 12.3 |
| AD-1297641.1 | 74.2 | 6.0 | 90.5 | 31.3 | 92.7 | 6.3 | 101.5 | 20.7 |
| AD-1297642.1 | 50.8 | 13.4 | 87.0 | 13.3 | 82.3 | 6.7 | 101.5 | 15.8 |
| AD-1297643.1 | 44.1 | 6.1 | 79.7 | n/a | 102.6 | 15.2 | 120.1 | 24.2 |
| AD-1297644.1 | 73.8 | 19.0 | 87.5 | 23.9 | 80.4 | 22.3 | 99.8 | 36.1 |
| AD-1297645.1 | 80.8 | 26.6 | 100.5 | 15.6 | 92.8 | 31.6 | 103.2 | 15.6 |
| AD-1136073.2 | 54.6 | 20.8 | 125.2 | 25.4 | 135.6 | 21.5 | 114.8 | 14.6 |
| AD-1136074.2 | 72.1 | n/a | 79.6 | 7.4 | 88.6 | 19.7 | 129.9 | 3.6 |
| AD-1136075.2 | 38.2 | 9.0 | 52.3 | 15.5 | 90.8 | 28.0 | 76.2 | 15.0 |
| AD-1136076.2 | 82.6 | 15.6 | 114.4 | 55.2 | 116.3 | 29.6 | 116.6 | 26.6 |
| AD-1136077.2 | 58.6 | 19.5 | 72.0 | 8.4 | 82.5 | 19.2 | 102.0 | 33.4 |
| AD-1136078.2 | 86.7 | 5.2 | 129.5 | 18.3 | 118.8 | 14.8 | 108.6 | 19.1 |
| AD-1297646.1 | 69.8 | 17.8 | 123.8 | 58.6 | 93.4 | 10.9 | 137.9 | 28.8 |
| AD-1297647.1 | 58.3 | 9.4 | 56.0 | 16.9 | 122.6 | 18.1 | 119.8 | 18.6 |

TABLE 8-continued

Xanthine Dehydrogenase dsRNA Agent In Vitro Single Dose Screens in Primary Human Hepatocytes

| | PHH | | | | | | | |
|---|---|---|---|---|---|---|---|---|
| | 500 nM | | 100 nM | | 10 nM | | 0.1 nM | |
| DuplexID | % of Avg Message Remaining | ST DEV | % of Avg Message Remaining | ST DEV | % of Avg Message Remaining | ST DEV | % of Avg Message Remaining | ST DEV |
| AD-1297648.1 | 86.3 | 12.5 | 90.3 | 0.0 | 95.0 | 23.8 | 140.1 | 35.6 |
| AD-1297649.1 | 42.0 | 13.5 | 70.2 | 14.8 | 92.5 | 15.1 | 90.3 | 4.5 |
| AD-1297650.1 | 68.8 | 6.7 | 80.5 | 18.9 | 103.1 | 8.2 | 121.7 | 8.8 |
| AD-1297651.1 | 68.3 | 5.8 | 99.0 | 28.3 | 73.4 | 14.4 | 105.5 | 22.0 |
| AD-1297652.1 | 99.0 | 30.9 | 109.3 | 18.4 | 111.7 | 25.7 | 103.6 | 8.6 |
| AD-1297653.1 | 53.3 | 15.2 | 88.9 | 62.0 | 111.2 | 27.5 | 95.2 | 16.1 |
| AD-1297654.1 | 126.3 | 16.6 | 110.5 | 19.0 | 105.7 | 10.3 | 91.4 | 8.1 |
| AD-1297655.1 | 116.3 | 11.7 | 124.4 | 22.3 | 87.0 | 8.5 | 126.4 | 11.7 |
| AD-1297656.1 | 83.3 | 14.8 | 65.2 | 6.7 | 101.1 | 18.3 | 90.7 | 18.0 |
| AD-1297657.1 | 22.0 | 8.2 | 51.6 | 49.2 | 62.9 | 8.9 | 107.5 | 30.9 |
| AD-1297658.1 | 71.1 | 3.5 | 78.2 | 14.6 | 103.9 | 10.2 | 106.4 | 11.4 |
| AD-1297659.1 | 63.9 | 18.4 | 73.0 | 22.4 | 89.1 | 10.1 | 95.7 | 18.8 |
| AD-1297660.1 | 54.6 | 13.9 | 70.9 | 44.2 | 101.9 | 19.1 | 90.4 | 19.2 |
| AD-1297661.1 | 67.9 | 35.5 | 61.7 | 14.7 | 91.0 | 23.6 | 81.0 | 33.3 |
| AD-1297662.1 | 74.3 | 15.3 | 69.9 | 16.7 | 97.1 | 21.9 | 79.0 | 19.9 |
| AD-1297663.1 | 77.0 | 24.1 | 36.6 | 7.8 | 85.9 | 25.6 | 103.4 | 7.0 |
| AD-1136082.2 | 57.0 | 0.6 | 65.1 | 13.3 | 47.7 | 8.6 | n/d | n/d |
| AD-1136083.2 | 82.2 | 8.9 | 76.8 | 26.0 | 41.1 | 19.0 | n/d | n/d |
| AD-1136084.2 | 81.8 | 7.2 | 87.4 | 13.5 | 50.2 | 8.6 | n/d | n/d |
| AD-1136085.2 | 98.6 | 21.4 | 102.9 | 38.2 | 75.8 | 30.0 | n/d | n/d |
| AD-1136086.2 | 91.7 | 33.5 | 102.1 | 10.8 | 67.5 | 8.4 | n/d | n/d |
| AD-1136087.2 | 87.2 | 23.0 | 63.5 | 1.9 | 54.8 | 12.9 | n/d | n/d |
| AD-1136088.2 | 99.5 | 11.4 | 73.3 | 24.0 | 69.1 | 7.2 | n/d | n/d |
| AD-1136089.2 | 87.8 | 11.4 | 96.4 | 43.3 | 57.6 | 18.6 | n/d | n/d |
| AD-1136090.2 | 101.3 | 15.8 | 116.1 | 14.8 | 74.6 | 20.4 | n/d | n/d |
| AD-1297664.1 | 73.8 | 12.3 | 84.0 | 6.5 | 65.7 | 3.8 | n/d | n/d |
| AD-1136091.2 | 52.3 | 14.5 | 58.2 | 11.3 | 55.3 | 15.3 | n/d | n/d |
| AD-1136092.2 | 62.4 | 6.9 | 71.3 | 10.6 | 55.6 | 26.6 | n/d | n/d |
| AD-1297665.1 | 62.9 | 10.6 | 75.5 | 6.9 | 62.1 | 11.5 | n/d | n/d |
| AD-1297666.1 | 54.8 | 13.8 | 59.6 | 15.2 | 51.1 | 7.3 | n/d | n/d |
| AD-1297667.1 | 65.8 | 5.0 | 66.6 | 24.9 | 63.3 | 14.4 | n/d | n/d |
| AD-1297668.1 | 66.2 | 10.2 | 68.8 | 3.7 | 54.6 | 15.8 | n/d | n/d |
| AD-1297669.1 | 73.4 | 9.4 | 72.2 | 2.5 | 65.9 | 13.6 | n/d | n/d |
| AD-1297670.1 | 57.1 | 7.3 | 73.4 | 19.6 | 61.2 | 8.5 | n/d | n/d |

TABLE 8-continued

Xanthine Dehydrogenase dsRNA Agent In Vitro Single Dose Screens in Primary Human Hepatocytes

| | PHH | | | | | | | |
|---|---|---|---|---|---|---|---|---|
| | 500 nM | | 100 nM | | 10 nM | | 0.1 nM | |
| DuplexID | % of Avg Message Remaining | ST DEV | % of Avg Message Remaining | ST DEV | % of Avg Message Remaining | ST DEV | % of Avg Message Remaining | ST DEV |
| AD-1297671.1 | 63.1 | 13.1 | 94.9 | 24.4 | 88.0 | 6.3 | n/d | n/d |
| AD-1297672.1 | 123.7 | 12.5 | 124.9 | 10.9 | 101.4 | 27.4 | n/d | n/d |
| AD-1297673.1 | 60.0 | 10.8 | 66.5 | 4.4 | 71.3 | 16.0 | n/d | n/d |
| AD-1297674.1 | 96.2 | 26.1 | 111.6 | 8.5 | 110.5 | 9.5 | n/d | n/d |
| AD-1297675.1 | 75.1 | 3.9 | 95.9 | 3.3 | 73.9 | 48.8 | n/d | n/d |
| AD-1136159.2 | 56.0 | 6.6 | 106.5 | 19.2 | 55.0 | 9.8 | n/d | n/d |
| AD-1136160.2 | 69.8 | 15.3 | 84.4 | 6.2 | 81.7 | 8.5 | n/d | n/d |
| AD-1136161.2 | 75.8 | 24.6 | 96.5 | 20.6 | 93.1 | 5.0 | n/d | n/d |
| AD-1136162.2 | 73.6 | 8.4 | 74.9 | 19.7 | 76.2 | 10.7 | n/d | n/d |
| AD-1136163.2 | 62.4 | 14.7 | 86.2 | 18.7 | 55.2 | 20.3 | n/d | n/d |
| AD-1297676.1 | 59.9 | 11.9 | 65.8 | 22.6 | 88.1 | 36.6 | n/d | n/d |
| AD-1136164.2 | 94.5 | 11.4 | 100.5 | 14.2 | 92.6 | 23.3 | n/d | n/d |
| AD-1136165.2 | 69.2 | 16.2 | 71.0 | 6.2 | 64.7 | 9.2 | n/d | n/d |
| AD-1136166.2 | 47.1 | 9.8 | 56.5 | 21.4 | 70.8 | 5.0 | n/d | n/d |
| AD-1136167.2 | 107.0 | 14.0 | 102.6 | 27.8 | 86.2 | 9.9 | n/d | n/d |
| AD-1136168.2 | 104.9 | 22.3 | 86.7 | 26.5 | 98.1 | 15.2 | n/d | n/d |
| AD-1136169.2 | 64.4 | 21.6 | 54.5 | 16.6 | 67.6 | 15.3 | n/d | n/d |
| AD-1136170.2 | 64.6 | 14.6 | 66.7 | 12.0 | 80.8 | 12.9 | n/d | n/d |
| AD-1136171.2 | 100.8 | 17.6 | 111.3 | 13.2 | 106.0 | 21.1 | n/d | n/d |
| AD-1136172.2 | 72.0 | 14.2 | 88.1 | 23.7 | 69.4 | 28.7 | n/d | n/d |
| AD-1136173.2 | 97.4 | 26.7 | 103.0 | 57.7 | 78.0 | 1.1 | n/d | n/d |
| AD-1297677.1 | 96.1 | 26.8 | 106.2 | 38.5 | 93.4 | 26.2 | n/d | n/d |
| AD-1136174.2 | 75.2 | 20.0 | 96.4 | 10.3 | 100.4 | 10.2 | n/d | n/d |
| AD-1297678.1 | 118.3 | 19.4 | 111.5 | 20.6 | 103.2 | 15.4 | n/d | n/d |
| AD-1297679.1 | 116.0 | 12.2 | 112.6 | 31.9 | 111.8 | 7.4 | n/d | n/d |
| AD-1297680.1 | 90.0 | 27.9 | 95.8 | 29.6 | 105.8 | 20.4 | n/d | n/d |
| AD-1297681.1 | 105.9 | 13.9 | 109.2 | 10.6 | 111.6 | 16.4 | n/d | n/d |
| AD-1297682.1 | 77.2 | 14.6 | 92.4 | 4.5 | 76.6 | 16.7 | n/d | n/d |
| AD-1297683.1 | 64.0 | 14.8 | 90.5 | 16.1 | 71.8 | 14.7 | n/d | n/d |
| AD-1297684.1 | 87.4 | 2.0 | 87.7 | 15.4 | 71.7 | 31.3 | n/d | n/d |
| AD-1297685.1 | 90.2 | 15.1 | 94.3 | 5.2 | 113.9 | 38.3 | n/d | n/d |
| AD-1297686.1 | 94.7 | 9.8 | 80.8 | 7.5 | 117.1 | 21.2 | n/d | n/d |
| AD-1297687.1 | 58.8 | 11.8 | 79.6 | 2.4 | 106.6 | 18.3 | n/d | n/d |
| AD-1297688.1 | 82.2 | 5.0 | 78.0 | 26.0 | 78.6 | 6.3 | n/d | n/d |

TABLE 8-continued

Xanthine Dehydrogenase dsRNA Agent In Vitro Single Dose Screens in Primary Human Hepatocytes

| | PHH | | | | | | | |
|---|---|---|---|---|---|---|---|---|
| | 500 nM | | 100 nM | | 10 nM | | 0.1 nM | |
| DuplexID | % of Avg Message Remaining | ST DEV | % of Avg Message Remaining | ST DEV | % of Avg Message Remaining | ST DEV | % of Avg Message Remaining | ST DEV |
| AD-1297689.1 | 59.7 | 21.1 | 86.7 | 1.7 | 74.8 | 25.1 | n/d | n/d |
| AD-1297690.1 | 74.9 | 26.2 | 86.5 | 11.0 | 74.1 | 25.1 | n/d | n/d |
| AD-1297691.1 | 88.5 | 22.1 | 103.7 | 14.2 | 90.9 | 18.6 | n/d | n/d |
| AD-1297692.1 | 105.8 | 21.4 | 103.4 | 26.9 | 86.1 | 8.3 | n/d | n/d |
| AD-1136221.2 | 67.9 | 32.7 | 72.6 | 12.3 | 100.3 | 10.7 | n/d | n/d |
| AD-1136222.2 | 94.3 | 12.7 | 127.7 | 28.6 | 93.0 | 4.6 | n/d | n/d |
| AD-1297693.1 | 77.2 | 25.7 | 97.6 | 22.6 | 113.9 | 12.6 | n/d | n/d |
| AD-1297694.1 | 81.4 | 10.1 | 109.5 | 5.5 | 94.1 | 9.6 | n/d | n/d |
| AD-1136223.2 | 64.0 | 8.4 | 61.8 | 21.1 | 98.3 | 20.4 | n/d | n/d |
| AD-1136224.2 | 63.4 | 2.3 | 62.9 | 15.0 | 67.7 | 25.1 | n/d | n/d |
| AD-1136225.2 | 87.1 | 19.2 | 92.7 | 11.0 | 63.9 | 14.1 | n/d | n/d |
| AD-1297695.1 | 80.2 | 16.5 | 77.9 | 3.4 | 100.9 | 21.4 | n/d | n/d |
| AD-1297696.1 | 71.7 | 12.4 | 70.7 | 21.0 | 90.1 | 16.0 | n/d | n/d |
| AD-1297697.1 | 108.1 | 5.3 | 89.0 | 12.7 | 119.6 | 13.2 | n/d | n/d |
| AD-1136226.2 | 92.0 | 4.1 | 95.4 | 29.2 | 100.4 | 14.5 | n/d | n/d |
| AD-1136227.2 | 60.5 | 15.7 | 91.0 | 1.8 | 74.5 | 17.4 | n/d | n/d |
| AD-1136228.2 | 61.2 | 4.0 | 77.8 | 18.6 | 57.0 | 13.0 | n/d | n/d |
| AD-1136229.2 | 78.3 | 12.0 | 80.1 | 8.3 | 89.1 | 18.7 | n/d | n/d |
| AD-1136230.2 | 92.2 | 19.3 | 106.9 | 14.0 | 82.9 | 14.7 | n/d | n/d |
| AD-1136231.2 | 96.9 | 12.5 | 85.5 | 14.0 | 95.5 | 14.0 | n/d | n/d |
| AD-1136232.2 | 79.5 | 8.3 | 73.1 | 24.7 | 87.6 | 15.3 | n/d | n/d |
| AD-1297698.1 | 76.3 | 7.0 | 79.1 | 23.3 | 101.6 | 21.5 | n/d | n/d |
| AD-1297699.1 | 44.5 | 12.0 | 67.5 | 17.5 | 87.0 | 19.1 | n/d | n/d |
| AD-1297700.1 | 86.3 | 19.6 | 82.6 | 19.5 | 58.2 | 8.5 | n/d | n/d |
| AD-1136233.2 | 86.6 | 14.4 | 80.5 | 9.5 | 73.6 | 11.6 | n/d | n/d |
| AD-1136234.2 | 85.4 | 15.2 | 77.1 | 13.1 | 80.3 | 17.2 | n/d | n/d |
| AD-1297701.1 | 79.3 | 8.4 | 84.4 | 14.6 | 72.0 | 24.3 | n/d | n/d |
| AD-1297702.1 | 100.3 | 3.2 | 83.1 | 11.3 | 95.1 | 14.0 | n/d | n/d |
| AD-1297703.1 | 78.0 | 26.3 | 117.3 | 16.3 | 112.4 | 34.5 | n/d | n/d |
| AD-1297704.1 | 85.1 | 8.4 | 95.1 | 24.5 | 111.8 | 37.5 | n/d | n/d |
| AD-1297705.1 | 74.4 | 17.9 | 84.1 | 56.6 | 103.6 | 6.6 | n/d | n/d |
| AD-1297706.1 | 101.6 | 28.1 | 68.8 | 32.4 | 47.8 | 6.1 | n/d | n/d |
| AD-1297707.1 | 94.1 | 21.1 | 86.9 | 8.5 | 62.1 | 23.6 | n/d | n/d |
| AD-1297708.1 | 80.7 | 18.7 | 76.0 | 12.5 | 82.0 | 13.4 | n/d | n/d |

TABLE 8-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1297709.1 | 78.1 | 8.8 | 74.3 | 26.0 | 72.2 | 18.5 | n/d | n/d |
| AD-1297710.1 | 68.9 | 12.3 | 79.7 | 20.2 | 79.0 | 14.7 | n/d | n/d |
| AD-1297711.1 | 78.2 | 17.6 | 95.3 | 27.3 | 72.0 | 9.0 | n/d | n/d |
| AD-1297712.1 | 86.2 | 10.5 | 88.8 | 16.4 | 90.9 | 26.1 | n/d | n/d |

TABLE 9

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1135990.2 | 77.7 | 14.6 | 46.5 | 24.5 | 40.3 | 26.2 | 53.9 | 33.2 |
| AD-1135991.2 | 60.7 | 15.3 | 35.9 | 16.3 | 41.1 | 14.3 | 75.1 | 36.6 |
| AD-1297597.1 | 56.8 | 25.9 | 36.9 | 11.8 | 72.0 | 45.0 | 51.9 | 24.4 |
| AD-1297598.1 | 44.7 | 28.8 | 69.4 | 28.7 | 48.5 | 26.4 | 79.8 | 25.9 |
| AD-1297599.1 | 83.4 | 29.1 | 97.6 | 37.6 | 50.7 | 15.3 | 78.5 | 20.8 |
| AD-1297600.1 | 88.1 | 21.6 | 43.5 | 12.7 | 45.6 | 7.3 | 70.4 | 21.5 |
| AD-1297601.1 | 57.5 | 40.4 | 46.3 | 11.3 | 49.5 | 9.4 | 72.6 | 21.3 |
| AD-1135992.2 | 50.9 | 17.5 | 43.7 | 6.5 | 33.5 | 7.4 | 38.5 | 25.0 |
| AD-1135993.2 | 58.0 | 16.6 | 79.5 | 21.3 | 63.4 | 48.2 | 71.4 | 39.9 |
| AD-1135994.2 | 117.8 | 14.1 | 81.7 | 22.1 | 103.8 | 30.2 | 102.9 | 39.5 |
| AD-1135995.2 | 131.8 | 27.0 | 78.5 | 22.8 | 152.4 | 18.4 | 120.4 | 28.1 |
| AD-1135996.2 | 47.0 | 16.3 | 49.9 | 19.2 | 115.5 | 18.3 | 89.3 | 22.1 |
| AD-1297602.1 | 48.7 | 31.0 | 106.6 | 39.7 | 97.9 | 27.4 | 82.2 | 16.9 |
| AD-1297603.1 | 108.1 | 42.1 | 88.7 | 18.4 | 81.5 | 35.9 | 72.8 | 14.8 |
| AD-1297604.1 | 62.9 | 36.3 | 66.1 | 16.0 | 69.7 | 15.9 | 90.1 | 9.7 |
| AD-1297605.1 | 49.1 | 14.5 | 45.4 | 14.3 | 69.5 | 44.7 | 48.9 | 16.4 |
| AD-1297606.1 | 74.2 | 20.6 | 79.3 | 13.2 | 43.3 | 7.8 | 63.1 | 7.3 |
| AD-1297607.1 | 68.6 | 35.0 | 63.8 | 30.0 | 44.3 | 10.3 | 99.1 | 19.8 |
| AD-1297608.1 | 75.7 | 39.0 | 85.4 | 38.0 | 85.7 | 21.5 | 87.4 | 11.7 |
| AD-1297609.1 | 114.4 | 26.2 | 99.9 | 35.8 | 98.8 | 16.2 | 95.8 | 34.8 |
| AD-1297610.1 | 87.7 | 8.0 | 73.1 | 31.8 | 72.3 | 22.7 | 102.1 | 23.6 |
| AD-1297611.1 | 93.5 | 18.0 | 71.8 | 20.5 | 57.3 | 26.1 | 81.0 | 15.2 |

TABLE 9-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1136037.2 | 53.2 | 8.0 | 48.1 | 22.9 | 65.4 | 8.6 | 52.6 | 22.2 |
| AD-1136038.2 | 58.1 | 25.6 | 26.4 | 3.6 | 37.2 | 13.9 | 67.7 | 21.8 |
| AD-1136039.2 | 72.8 | 19.0 | 54.2 | 30.3 | 75.6 | 28.9 | 82.3 | 30.9 |
| AD-1136040.2 | 122.9 | 44.6 | 123.6 | 56.7 | 89.2 | 31.0 | 67.6 | 8.7 |
| AD-1136041.2 | 123.5 | 38.0 | 138.3 | 31.7 | 85.7 | 28.1 | 131.5 | 22.0 |
| AD-1297612.1 | 132.7 | 41.5 | 137.2 | 41.0 | 107.2 | 34.9 | 123.0 | 17.7 |
| AD-1297613.1 | 73.8 | 31.3 | 88.3 | 31.9 | 83.8 | 24.7 | 98.0 | 22.7 |
| AD-1297614.1 | 79.8 | 12.9 | 103.4 | 36.9 | 67.2 | N/A | 68.9 | 30.2 |
| AD-1297615.1 | 123.9 | 44.3 | 94.2 | 69.5 | 86.7 | 40.1 | 96.3 | 43.2 |
| AD-1297616.1 | 106.0 | 35.0 | 85.7 | 41.7 | 84.4 | 29.8 | 112.5 | 12.9 |
| AD-1297617.1 | 60.7 | 22.5 | 99.8 | 66.2 | 85.9 | 46.1 | 141.1 | 32.9 |
| AD-1297618.1 | 111.7 | 43.5 | 135.2 | 44.2 | 98.6 | 46.9 | 109.9 | 21.0 |
| AD-1297619.1 | 110.0 | 14.8 | 133.3 | 29.2 | 126.3 | 42.2 | 120.9 | 39.1 |
| AD-1297620.1 | 84.4 | 26.6 | 135.3 | 39.8 | 91.7 | 15.7 | 114.7 | 15.3 |
| AD-1297621.1 | 60.2 | 20.8 | 77.7 | 7.4 | 88.2 | 32.9 | 85.4 | 15.5 |
| AD-1297622.1 | 77.1 | 19.3 | 96.8 | 29.0 | 105.2 | 55.1 | 69.2 | 37.5 |
| AD-1297623.1 | 85.5 | 40.2 | 82.6 | 28.3 | 148.1 | 48.2 | 92.7 | 42.3 |
| AD-1297624.1 | 44.0 | 5.7 | 61.2 | 9.0 | 91.6 | 1.6 | 104.6 | 69.2 |
| AD-1297625.1 | 117.2 | 42.9 | 121.1 | 41.8 | 131.3 | 43.9 | 120.6 | 47.1 |
| AD-1297626.1 | 112.4 | 26.9 | 118.6 | 66.3 | 134.0 | 24.6 | 145.2 | 41.0 |
| AD-1136050.2 | 62.9 | 27.3 | 74.8 | 13.0 | 149.8 | 50.5 | 142.6 | 26.7 |
| AD-1297627.1 | 95.4 | 39.7 | 79.4 | 26.9 | 110.3 | 32.9 | 129.4 | 16.4 |
| AD-1297628.1 | 79.7 | 27.1 | 59.1 | 15.5 | 68.3 | 19.3 | 96.1 | 16.2 |
| AD-1136051.2 | 39.1 | 21.5 | 34.8 | 18.9 | 53.6 | 49.8 | 62.8 | 16.7 |
| AD-1136052.2 | 77.1 | 17.9 | 65.1 | 44.0 | 95.6 | 49.0 | 98.3 | 36.1 |
| AD-1136053.2 | 76.2 | 40.2 | 100.9 | 6.9 | 108.5 | 44.0 | 101.0 | 11.9 |
| AD-1297629.1 | 90.8 | 46.5 | 97.0 | 23.5 | 108.3 | 33.9 | 122.0 | 41.3 |
| AD-1297630.1 | 119.0 | 29.3 | 141.6 | 67.2 | 151.1 | 46.4 | 138.4 | 32.1 |
| AD-1136054.2 | 123.4 | 8.4 | 104.4 | 32.9 | 117.1 | 27.4 | 113.9 | 15.5 |
| AD-1297631.1 | 78.3 | 9.5 | 118.5 | 49.3 | 127.7 | 20.5 | 116.4 | 36.1 |
| AD-1297632.1 | 53.1 | 10.2 | 35.8 | 9.4 | 93.9 | 17.2 | 59.1 | 19.8 |
| AD-1297633.1 | 80.5 | 31.1 | 68.3 | 50.4 | 102.5 | 61.9 | 91.1 | 8.7 |
| AD-1297634.1 | 107.7 | 25.2 | 101.7 | 40.4 | 112.3 | 18.7 | 137.5 | 36.5 |
| AD-1297635.1 | 126.7 | 22.6 | 138.4 | 77.3 | 142.0 | 40.9 | 132.4 | 15.3 |

TABLE 9-continued

Xanthine Dehydrogenase dsRNA Agent In Vitro Single Dose Screens in Primary Human Hepatocytes

| | PHH | | | | | | | |
|---|---|---|---|---|---|---|---|---|
| | 500 nM | | 100 nM | | 10 nM | | 0.1 nM | |
| DuplexID | % of Avg Message Remaining | ST DEV | % of Avg Message Remaining | ST DEV | % of Avg Message Remaining | ST DEV | % of Avg Message Remaining | ST DEV |
| AD-1297636.1 | 126.6 | 23.1 | 169.9 | 18.8 | 157.9 | 51.9 | 143.2 | 13.6 |
| AD-1297637.1 | 92.1 | 39.5 | 166.8 | 55.2 | 131.7 | 39.1 | 134.5 | 44.5 |
| AD-1297638.1 | 148.5 | 15.3 | 131.7 | 64.4 | 142.3 | 44.7 | 127.2 | 11.1 |
| AD-1297639.1 | 106.8 | 43.2 | 115.6 | 12.7 | 152.9 | 32.2 | 112.3 | 14.5 |
| AD-1297640.1 | 95.4 | 33.6 | 74.2 | 35.4 | 80.9 | 39.9 | 65.6 | 24.0 |
| AD-1297641.1 | 62.6 | 40.2 | 75.2 | 38.8 | 101.0 | 40.2 | 91.7 | 35.7 |
| AD-1297642.1 | 94.0 | 27.1 | 87.7 | 25.2 | 107.6 | 42.4 | 100.7 | 26.6 |
| AD-1297643.1 | 171.8 | 19.3 | 163.5 | 59.8 | 148.8 | 39.6 | 144.6 | 47.4 |
| AD-1297644.1 | 120.4 | 27.8 | 116.4 | 74.3 | 159.7 | 41.0 | 146.9 | 35.2 |
| AD-1297645.1 | 132.7 | 16.5 | 124.9 | 68.2 | 135.4 | 47.3 | 131.8 | 14.5 |
| AD-1136073.2 | 107.0 | 29.3 | 84.4 | 19.5 | 110.2 | 40.6 | 87.2 | 13.5 |
| AD-1136074.2 | 64.0 | 37.4 | 75.5 | 9.9 | 77.0 | 43.9 | 46.7 | 17.6 |
| AD-1136075.2 | 57.4 | 28.4 | 55.8 | 14.3 | 75.8 | 54.4 | 105.1 | 2.4 |
| AD-1136076.2 | 134.2 | 49.0 | 77.6 | 41.8 | 113.1 | 45.4 | 129.4 | 22.5 |
| AD-1136077.2 | 113.0 | 39.9 | 120.7 | 46.9 | 137.8 | 37.8 | 142.3 | 14.0 |
| AD-1136078.2 | 131.8 | 55.1 | 178.5 | 56.6 | 162.1 | 67.7 | 123.9 | 5.3 |
| AD-1297646.1 | 93.7 | 34.8 | 136.6 | 47.1 | 166.9 | 10.2 | 131.9 | 14.5 |
| AD-1297647.1 | 93.6 | 35.1 | 64.8 | 30.2 | 114.4 | 17.8 | 102.2 | 31.1 |
| AD-1297648.1 | 93.2 | 37.3 | 71.0 | 18.1 | 105.6 | 16.3 | 50.9 | 6.0 |
| AD-1297649.1 | 42.1 | 9.3 | 48.7 | 24.7 | 42.6 | 20.2 | 53.8 | 11.5 |
| AD-1297650.1 | 99.4 | 15.2 | 152.2 | 18.6 | 135.9 | 21.5 | 121.5 | 16.7 |
| AD-1297651.1 | 95.1 | 26.3 | 108.1 | 38.1 | 85.9 | 24.5 | 102.8 | 21.6 |
| AD-1297652.1 | 154.3 | 23.3 | 135.2 | 52.7 | 139.4 | 29.3 | 132.3 | 10.5 |
| AD-1297653.1 | 83.7 | 34.5 | 76.3 | 32.5 | 138.2 | 47.7 | 140.0 | 10.9 |
| AD-1297654.1 | 117.1 | 41.4 | 71.0 | 25.4 | 141.1 | 68.1 | 90.2 | 6.9 |
| AD-1297655.1 | 86.2 | 32.0 | 94.8 | 23.8 | 108.4 | 27.9 | 83.0 | 19.5 |
| AD-1297656.1 | 82.2 | 45.6 | 59.4 | 28.2 | 75.7 | 44.5 | 38.7 | 16.3 |
| AD-1297657.1 | 26.2 | 3.2 | 23.2 | 11.8 | 54.0 | 51.9 | 55.2 | 27.3 |
| AD-1297658.1 | 72.2 | 16.6 | 82.9 | 48.2 | 72.9 | 51.9 | 84.7 | 25.9 |
| AD-1297659.1 | 64.9 | 27.0 | 60.3 | 13.8 | 91.4 | 40.8 | 66.0 | 24.7 |
| AD-1297660.1 | 63.0 | 27.9 | 98.7 | 51.5 | 77.7 | 69.3 | 93.3 | 33.9 |
| AD-1297661.1 | 39.7 | 24.5 | 68.4 | 30.8 | 69.3 | 32.7 | 93.8 | 25.5 |
| AD-1297662.1 | 58.6 | 25.8 | 42.1 | 12.7 | 48.2 | 30.1 | 64.3 | 16.4 |
| AD-1297663.1 | 50.3 | 11.1 | 24.4 | 8.9 | 39.7 | 19.9 | 53.4 | 15.9 |

TABLE 9-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1136082.2 | 16.1 | 10.8 | 64.9 | 27.2 | 81.5 | 20.2 | 81.5 | 20.2 |
| AD-1136083.2 | 51.2 | 13.6 | 72.2 | 16.5 | 102.0 | 14.1 | 102.0 | 14.1 |
| AD-1136084.2 | 55.5 | 32.4 | 98.3 | 30.3 | 112.8 | 22.6 | 112.8 | 22.6 |
| AD-1136085.2 | 57.8 | 35.2 | 84.0 | 23.8 | 124.3 | 4.7 | 124.3 | 4.7 |
| AD-1136086.2 | 79.6 | 24.1 | 112.1 | 8.6 | 92.6 | 29.1 | 92.6 | 29.1 |
| AD-1136087.2 | 62.4 | 7.5 | 80.3 | 19.8 | 93.5 | 13.7 | 93.5 | 13.7 |
| AD-1136088.2 | 64.3 | 10.4 | 96.8 | 8.3 | 94.2 | 30.4 | 94.2 | 30.4 |
| AD-1136089.2 | 40.8 | 31.0 | 55.3 | 15.4 | 88.4 | 23.2 | 88.4 | 23.2 |
| AD-1136090.2 | 61.4 | 30.3 | 131.1 | 32.5 | 137.3 | 33.0 | 137.3 | 33.0 |
| AD-1297664.1 | 96.5 | 25.0 | 100.0 | 21.1 | 135.0 | 35.2 | 135.0 | 35.2 |
| AD-1136091.2 | 74.3 | 29.0 | 84.0 | 28.1 | 95.3 | 11.3 | 95.3 | 11.3 |
| AD-1136092.2 | 83.0 | 31.0 | 66.2 | 14.4 | 108.0 | 7.5 | 108.0 | 7.5 |
| AD-1297665.1 | 62.2 | 25.2 | 68.7 | 20.6 | 88.4 | 9.3 | 88.4 | 9.3 |
| AD-1297666.1 | 51.2 | 13.0 | 47.1 | 7.5 | 78.9 | 12.0 | 78.9 | 12.0 |
| AD-1297667.1 | 55.4 | 18.2 | 67.5 | 21.1 | 70.5 | 10.2 | 70.5 | 10.2 |
| AD-1297668.1 | 50.9 | 18.1 | 70.6 | 15.2 | 98.5 | 19.5 | 98.5 | 19.5 |
| AD-1297669.1 | 52.7 | 18.5 | 99.2 | 21.6 | 103.8 | 19.6 | 103.8 | 19.6 |
| AD-1297670.1 | 80.5 | 26.4 | 88.7 | 32.0 | 113.9 | 8.1 | 113.9 | 8.1 |
| AD-1297671.1 | 71.4 | 24.3 | 71.7 | 7.8 | 98.7 | 7.6 | 98.7 | 7.6 |
| AD-1297672.1 | 103.0 | 4.8 | 97.6 | 3.4 | 119.4 | 33.0 | 119.4 | 33.0 |
| AD-1297673.1 | 47.8 | 19.5 | 60.8 | 21.7 | 98.4 | 10.1 | 98.4 | 10.1 |
| AD-1297674.1 | 96.5 | 17.6 | 86.3 | 14.8 | 93.4 | 11.4 | 93.4 | 11.4 |
| AD-1297675.1 | 42.9 | 9.7 | 72.8 | 16.2 | 80.5 | 10.6 | 80.5 | 10.6 |
| AD-1136159.2 | 76.7 | 20.7 | 65.0 | 25.8 | 107.4 | 22.5 | 107.4 | 22.5 |
| AD-1136160.2 | 74.6 | 15.1 | 77.2 | 20.1 | 131.3 | 1.6 | 131.3 | 1.6 |
| AD-1136161.2 | 81.1 | 33.0 | 80.1 | 20.6 | 103.6 | 26.3 | 103.6 | 26.3 |
| AD-1136162.2 | 66.4 | 12.3 | 88.3 | 37.3 | 124.8 | 13.6 | 124.8 | 13.6 |
| AD-1136163.2 | 69.6 | 18.4 | 50.6 | 8.3 | 89.5 | 11.6 | 89.5 | 11.6 |
| AD-1297676.1 | 55.7 | 30.9 | 51.5 | 14.1 | 78.1 | 17.8 | 78.1 | 17.8 |
| AD-1136164.2 | 41.7 | 11.4 | 79.9 | 27.9 | 72.8 | 23.5 | 72.8 | 23.5 |
| AD-1136165.2 | 57.4 | 18.9 | 91.6 | 15.6 | 109.6 | 20.4 | 109.6 | 20.4 |
| AD-1136166.2 | 70.7 | 19.9 | 62.2 | 24.4 | 110.2 | 28.8 | 110.2 | 28.8 |
| AD-1136167.2 | 117.2 | 19.8 | 100.5 | 32.0 | 145.2 | 13.9 | 145.2 | 13.9 |
| AD-1136168.2 | 72.9 | 11.4 | 69.2 | 12.1 | 115.2 | 25.9 | 115.2 | 25.9 |

TABLE 9-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1136169.2 | 52.4 | 6.6 | 39.9 | 7.6 | 105.5 | 15.2 | 105.5 | 15.2 |
| AD-1136170.2 | 60.2 | 13.0 | 58.5 | 34.9 | 88.9 | 22.0 | 88.9 | 22.0 |
| AD-1136171.2 | 93.8 | 9.6 | 75.3 | 11.1 | 72.9 | 15.5 | 72.9 | 15.5 |
| AD-1136172.2 | 55.6 | 25.3 | 65.7 | 17.7 | 83.9 | 21.8 | 83.9 | 21.8 |
| AD-1136173.2 | 79.0 | 36.1 | 120.7 | 34.2 | 127.9 | 14.1 | 127.9 | 14.1 |
| AD-1297677.1 | 89.9 | 17.7 | 100.3 | 37.6 | 90.2 | 34.0 | 90.2 | 34.0 |
| AD-1136174.2 | 84.7 | 10.4 | 94.9 | 28.6 | 113.4 | 16.5 | 113.4 | 16.5 |
| AD-1297678.1 | 110.9 | 29.0 | 76.8 | 13.1 | 140.0 | 13.6 | 140.0 | 13.6 |
| AD-1297679.1 | 115.4 | 5.5 | 120.9 | 35.8 | 122.2 | 23.8 | 122.2 | 23.8 |
| AD-1297680.1 | 98.6 | 13.3 | 102.9 | 31.1 | 103.7 | 0.8 | 103.7 | 0.8 |
| AD-1297681.1 | 97.1 | 14.8 | 84.5 | 27.3 | 95.6 | 17.1 | 95.6 | 17.1 |
| AD-1297682.1 | 95.1 | 15.9 | 111.8 | 16.7 | 116.9 | 32.7 | 116.9 | 32.7 |
| AD-1297683.1 | 101.0 | 20.4 | 85.3 | 21.6 | 128.9 | 12.9 | 128.9 | 12.9 |
| AD-1297684.1 | 92.9 | 24.8 | 69.1 | 12.3 | 109.7 | 21.6 | 109.7 | 21.6 |
| AD-1297685.1 | 54.7 | 12.1 | 67.4 | 27.5 | 103.5 | 5.8 | 103.5 | 5.8 |
| AD-1297686.1 | 81.4 | 10.3 | 98.4 | 30.3 | 115.9 | 14.0 | 115.9 | 14.0 |
| AD-1297687.1 | 62.0 | 8.1 | 63.0 | 18.0 | 102.1 | 8.7 | 102.1 | 8.7 |
| AD-1297688.1 | 41.4 | 12.5 | 49.4 | 10.4 | 74.8 | 20.3 | 74.8 | 20.3 |
| AD-1297689.1 | 61.0 | 16.6 | 51.0 | 12.1 | 58.3 | 8.2 | 58.3 | 8.2 |
| AD-1297690.1 | 64.4 | 28.9 | 89.6 | 27.5 | 116.6 | 25.3 | 116.6 | 25.3 |
| AD-1297691.1 | 75.7 | 22.0 | 99.7 | 24.9 | 123.5 | 26.7 | 123.5 | 26.7 |
| AD-1297692.1 | 130.0 | 27.2 | 100.0 | 30.0 | 127.8 | 23.3 | 127.8 | 23.3 |
| AD-1136221.2 | 86.4 | 21.5 | 72.9 | 42.0 | 107.5 | 5.2 | 107.5 | 5.2 |
| AD-1136222.2 | 142.1 | 15.6 | 109.6 | 38.9 | 113.9 | 6.6 | 113.9 | 6.6 |
| AD-1297693.1 | 75.4 | 15.8 | 88.4 | 20.8 | 95.6 | 11.1 | 95.6 | 11.1 |
| AD-1297694.1 | 77.5 | 15.8 | 55.3 | 3.2 | 76.3 | 13.9 | 76.3 | 13.9 |
| AD-1136223.2 | 64.0 | 15.5 | 46.8 | 13.9 | 57.7 | 9.7 | 57.7 | 9.7 |
| AD-1136224.2 | 69.5 | 29.1 | 66.2 | 20.4 | 101.5 | 27.0 | 101.5 | 27.0 |
| AD-1136225.2 | 98.8 | 35.1 | 70.1 | 20.9 | 117.7 | 25.2 | 117.7 | 25.2 |
| AD-1297695.1 | 69.5 | 18.8 | 88.6 | 37.0 | 128.0 | 25.9 | 128.0 | 25.9 |
| AD-1297696.1 | 61.8 | 23.2 | 50.8 | 18.2 | 102.3 | 23.1 | 102.3 | 23.1 |
| AD-1297697.1 | 95.3 | 13.1 | 68.6 | 5.8 | 100.1 | 15.8 | 100.1 | 15.8 |
| AD-1136226.2 | 47.2 | 12.2 | 63.1 | 9.2 | 80.5 | 41.8 | 80.5 | 41.8 |
| AD-1136227.2 | 55.1 | 8.6 | 44.5 | 7.5 | 64.3 | 11.1 | 64.3 | 11.1 |

TABLE 9-continued

Xanthine Dehydrogenase dsRNA Agent In Vitro Single Dose Screens in Primary Human Hepatocytes

| DuplexID | PHH | | | | | | | |
|---|---|---|---|---|---|---|---|---|
| | 500 nM | | 100 nM | | 10 nM | | 0.1 nM | |
| | % of Avg Message Remaining | ST DEV | % of Avg Message Remaining | ST DEV | % of Avg Message Remaining | ST DEV | % of Avg Message Remaining | ST DEV |
| AD-1136228.2 | 84.9 | 13.5 | 94.7 | 27.3 | 91.2 | 17.2 | 91.2 | 17.2 |
| AD-1136229.2 | 91.9 | 10.5 | 95.3 | 27.5 | 116.4 | 23.4 | 116.4 | 23.4 |
| AD-1136230.2 | 119.7 | 22.0 | 68.4 | 23.2 | 106.2 | 9.2 | 106.2 | 9.2 |
| AD-1136231.2 | 85.7 | 6.8 | 76.5 | 31.1 | 94.5 | 13.6 | 94.5 | 13.6 |
| AD-1136232.2 | 72.4 | 12.4 | 67.0 | 11.6 | 94.9 | 23.9 | 94.9 | 23.9 |
| AD-1297698.1 | 61.6 | 13.7 | 54.5 | 8.9 | 83.4 | 26.1 | 83.4 | 26.1 |
| AD-1297699.1 | 46.0 | 5.9 | 55.4 | 14.6 | 66.6 | 14.0 | 66.6 | 14.0 |
| AD-1297700.1 | 92.2 | 41.6 | 95.2 | 10.8 | 114.1 | 24.6 | 114.1 | 24.6 |
| AD-1136233.2 | 117.7 | 27.6 | 117.3 | 16.1 | 110.6 | 8.0 | 110.6 | 8.0 |
| AD-1136234.2 | 108.2 | 22.1 | 62.1 | 4.6 | 87.5 | 17.3 | 87.5 | 17.3 |
| AD-1297701.1 | 102.5 | 11.9 | 84.4 | 12.8 | 74.9 | 8.8 | 74.9 | 8.8 |
| AD-1297702.1 | 121.5 | 19.7 | 76.0 | 6.6 | 91.9 | 21.3 | 91.9 | 21.3 |
| AD-1297703.1 | 104.9 | 10.6 | 67.7 | 10.4 | 79.2 | 10.8 | 79.2 | 10.8 |
| AD-1297704.1 | 61.2 | 22.3 | 75.7 | 9.8 | 85.7 | 9.3 | 85.7 | 9.3 |
| AD-1297705.1 | 68.6 | 36.2 | 89.9 | 32.2 | 71.0 | 7.8 | 71.0 | 7.8 |
| AD-1297706.1 | 49.9 | 41.2 | 93.7 | 9.8 | 95.2 | 24.0 | 95.2 | 24.0 |
| AD-1297707.1 | 83.3 | 18.6 | 107.2 | 7.7 | 106.5 | 8.3 | 106.5 | 8.3 |
| AD-1297708.1 | 95.8 | 15.7 | 93.9 | 27.1 | 86.3 | 10.0 | 86.3 | 10.0 |
| AD-1297709.1 | 89.9 | 23.6 | 92.7 | 20.2 | 83.5 | 14.1 | 83.5 | 14.1 |
| AD-1297710.1 | 74.2 | 20.8 | 94.7 | 10.3 | 74.2 | 3.5 | 74.2 | 3.5 |
| AD-1297711.1 | 59.4 | 36.2 | 114.5 | 22.5 | 72.3 | 3.0 | 72.3 | 3.0 |
| AD-1297712.1 | 87.3 | 12.2 | 88.3 | 7.6 | 88.9 | 10.3 | 88.9 | 10.3 |

TABLE 10

Xanthine Dehydrogenase dsRNA Agent In Vitro Single Dose Screens in Primary Human Hepatocytes

| | Dose (nM) | 100 | 20 | 4 | 0.8 | 0.16 | 0.032 | 0.0064 | 0.00128 | 0.000256 | 5.12E−05 |
|---|---|---|---|---|---|---|---|---|---|---|---|
| % Message Remaining Avg | AD-1395794.1 | 30.7 | 30.6 | 40.2 | 35.9 | 36.1 | 33.5 | 55.7 | 53.3 | 69.1 | 60.5 |
| | AD-1136038.3 | 43.5 | 36.9 | 40.5 | 35.5 | 43.0 | 59.8 | 61.4 | 61.1 | 94.7 | 76.9 |
| | AD-1395797.1 | 45.8 | 45.8 | 53.6 | 68.5 | 58.9 | 70.2 | 100.1 | 89.7 | 128.6 | 105.1 |
| | AD-1135991.3 | 42.0 | 44.8 | 32.0 | 54.1 | 54.0 | 61.7 | 68.4 | 71.8 | 91.1 | 104.4 |
| | AD-1297597.2 | 56.7 | 51.3 | 46.3 | 43.4 | 56.9 | 76.7 | 86.5 | 89.4 | 75.7 | 84.5 |
| | AD-1395803.1 | 39.4 | 43.6 | 35.7 | 42.3 | 53.2 | 48.2 | 82.5 | 79.5 | 79.1 | 69.3 |
| | AD-1395805.1 | 32.7 | 45.1 | 34.5 | 43.1 | 43.3 | 81.0 | 84.0 | 76.3 | 85.7 | 100.7 |
| | PBS avg | 106.5 | | | | | | | | | |
| Stdev | AD-1395794.1 | 9 | 7 | 8 | 7 | 10 | 2 | 18 | 11 | 19 | 17 |
| | AD-1136038.3 | 11 | 11 | 8 | 9 | 5 | 10 | 16 | 16 | 19 | 10 |
| | AD-1395797.1 | 1 | 10 | 9 | 8 | 18 | 22 | 10 | 14 | 13 | 34 |
| | AD-1135991.3 | 13 | 14 | 15 | 15 | 17 | 10 | 18 | 18 | 22 | 35 |
| | AD-1297597.2 | 7 | 8 | 4 | 14 | 9 | 16 | 12 | 16 | 31 | 8 |

TABLE 10-continued

Xanthine Dehydrogenase dsRNA Agent In Vitro Single Dose Screens in Primary Human Hepatocytes

| Dose (nM) | 100 | 20 | 4 | 0.8 | 0.16 | 0.032 | 0.0064 | 0.00128 | 0.000256 | 5.12E−05 |
|---|---|---|---|---|---|---|---|---|---|---|
| AD-1395803.1 | 10 | 5 | 4 | 15 | 18 | 17 | 14 | 28 | 16 | 19 |
| AD-1395805.1 | 8 | 16 | 6 | 6 | 9 | 27 | 24 | 20 | 15 | 25 |

TABLE 11

Xanthine Dehydrogenase dsRNA Agent In Vitro Single Dose Screens in Primary Human Hepatocytes

| | Dose (nM) | 100 | 20 | 4 | 0.8 | 0.16 | 0.032 | 0.0064 | 0.00128 | 0.000256 | 5.12E−05 |
|---|---|---|---|---|---|---|---|---|---|---|---|
| % Message Remaining Avg | AD-1395807.1 | 40.3 | 36.9 | 38.3 | 29.8 | 43.8 | 53.9 | 67.0 | 75.2 | 82.8 | 94.4 |
| | AD-1395811.1 | 45.7 | 42.5 | 39.9 | 47.9 | 64.4 | 64.7 | 80.8 | 99.3 | 114.2 | 98.0 |
| | AD-1297663.2 | 45.6 | 37.8 | 36.3 | 44.2 | 48.4 | 57.6 | 60.0 | 73.9 | 92.3 | 85.7 |
| | AD-1136008.2 | 46.4 | 50.6 | 39.3 | 42.2 | 49.6 | 69.4 | 86.4 | 94.2 | 120.7 | 102.0 |
| | AD-1395816.1 | 49.1 | 56.9 | 54.4 | 52.0 | 47.0 | 60.6 | 79.4 | 115.4 | 96.7 | 97.6 |
| | AD-1136061.2 | 46.9 | 52.1 | 48.3 | 49.4 | 45.5 | 66.8 | 77.0 | 103.3 | 129.1 | 99.5 |
| | AD-1135987.2 | 43.4 | 35.6 | 34.5 | 38.2 | 35.6 | 52.6 | 67.4 | 84.2 | 88.2 | 89.4 |
| | PBS avg | 100.3 | | | | | | | | | |
| Stdev | AD-1395807.1 | 12 | 7 | 7 | 5 | 8 | 14 | 10 | 11 | 11 | 13 |
| | AD-1395811.1 | 9 | 9 | 9 | 7 | 9 | 3 | 11 | 21 | 13 | 20 |
| | AD-1297663.2 | 5 | 12 | 10 | 12 | 4 | 7 | 8 | 18 | 26 | 19 |
| % Message Remaining Avg | AD-1395807.1 | 40.3 | 36.9 | 38.3 | 29.8 | 43.8 | 53.9 | 67.0 | 75.2 | 82.8 | 94.4 |
| | AD-1136008.2 | 2 | 12 | 9 | 9 | 7 | 9 | 18 | 24 | 27 | 22 |
| | AD-1395816.1 | 6 | 1 | 7 | 7 | 5 | 11 | 6 | 29 | 17 | 30 |
| | AD-1136061.2 | 4 | 7 | 10 | 6 | 8 | 6 | 24 | 18 | 28 | 13 |
| | AD-1135987.2 | 4 | 8 | 8 | 6 | 6 | 14 | 23 | 12 | 8 | 23 |

TABLE 12

Xanthine Dehydrogenase dsRNA Agent In Vitro Single Dose Screens in Primary Human Hepatocytes

| | Dose (nM) | 100 | 20 | 4 | 0.8 | 0.16 | 0.032 | 0.0064 | 0.00128 | 0.000256 |
|---|---|---|---|---|---|---|---|---|---|---|
| % Message Remaining Avg | AD-1395823.1 | 37.7 | 47.3 | 42.1 | 44.0 | 48.8 | 64.9 | 74.3 | 93.8 | 89.7 |
| | AD-1136166.3 | 47.2 | 50.7 | 42.3 | 49.4 | 64.4 | 77.1 | 86.3 | 98.9 | 102.1 |
| | AD-1136169.3 | 48.0 | 49.2 | 38.7 | 45.8 | 61.7 | 67.0 | 64.8 | 81.2 | 111.5 |
| | PBS avg | 100.5 | | | | | | | | |
| Stdev | AD-1395823.1 | 11 | 9 | 13 | 10 | 21 | 12 | 11 | 30 | 15 |
| | AD-1136166.3 | 15 | 14 | 14 | 12 | 12 | 11 | 8 | 23 | 14 |
| | AD-1136169.3 | 23 | 5 | 13 | 8 | 9 | 18 | 9 | 5 | 28 |

TABLE 13

IC$_{50}$ for Selected Xanthine Dehydrogenase dsRNA Agents Determined from In Vitro Single Dose Screens in Primary Human Hepatocytes

| Duplex ID | IC50 (nM) |
|---|---|
| AD-1395794.1 | 0.005 |
| AD-1136038.3 | 0.057 |
| AD-1395797.1 | 17.28 |
| AD-1135991.3 | 0.369 |
| AD-1297597.2 | 0.338 |
| AD-1395803.1 | 0.127 |
| AD-1395805.1 | 0.345 |
| AD-1395807.1 | 0.055 |
| AD-1395811.1 | 0.614 |
| AD-1297663.2 | 0.087 |
| AD-1136008.2 | 0.311 |
| AD-1395816.1 | 0.25 |
| AD-1136061.2 | 0.4 |
| AD-1135987.2 | 0.032 |
| AD-1395823.1 | 0.184 |
| AD-1136166.3 | 1.149 |
| AD-1136169.3 | 0.435 |

Example 4. In Vivo Screen in Non-Human Primates

Duplexes of interest identified from the in vitro studies were evaluated in vivo. In particular, the pharmacodynamic activity of various GalNAc-conjugated siRNAs targeting XDH was analyzed in Cynomolgus monkeys following a single subcutaneous injection of the siRNAs. Cynomolgus monkeys (3 females/group) in Groups 1 through 12 were subcutaneously administered vehicle (1×PBS) or a single 10 mg/kg dose of AD-1136091, AD-1395794, AD-1395805, AD-1136008, AD-1136038, AD-1395823, AD-1395816, AD-1136061, AD-1395811, or AD-1136166, or a single 5 mg/kg dose of AD-1135991. Group 13 was administered Allopurinol in vehicle of 0.5% carboxymethylcellulose sodium salt (prepared with sterile water for injection) at 10 mg/kg via daily oral gavage administration.

Liver samples were collected from Groups 1, 2, 5, 9, and 12 on Days −15, 21, 43 and Day 64. Liver samples were collected from Groups 3, 4, 6, 7, 8, 10, and 11 on Days −15, 21, and 42. Liver samples were collected from Group 13 on Day −15 and Day 15. All samples were analyzed for the levels of XDH messenger RNA (RT-qPCR) and XDH protein (Western blot).

Figure 2:
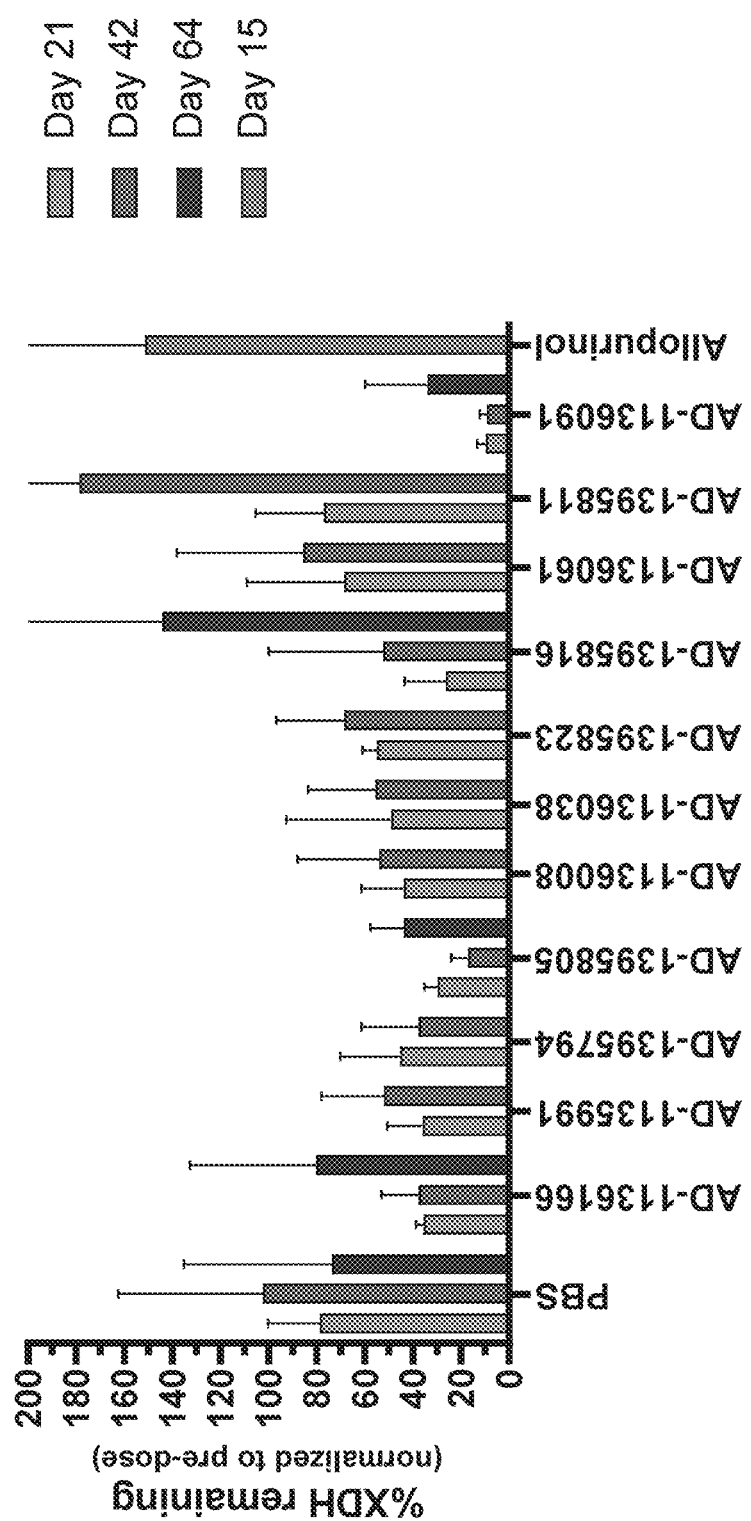
FIG. 2 depicts the levels of XDH protein in liver samples obtained from Cynomolgus monkeys following treatment with the indicated XDH targeting siRNAs or allopurinol.

For the RT-qPCR analysis, the mean liver XDH mRNA level relative to glycerol-3-phosphate dehydrogenase (GAPDH)] from each individual animal was normalized to its respective predose sample to determine the percentage of XDH mRNA relative to predose at each specified time point (FIG. 2).

Liver XDH protein levels were analyzed using western blot. The liver XDH protein level relative to beta-actin for each individual animal was normalized to its respective predose level to determine the percentage of XDH protein relative to predose at each specified time point (FIG. 3).

Figure 3:
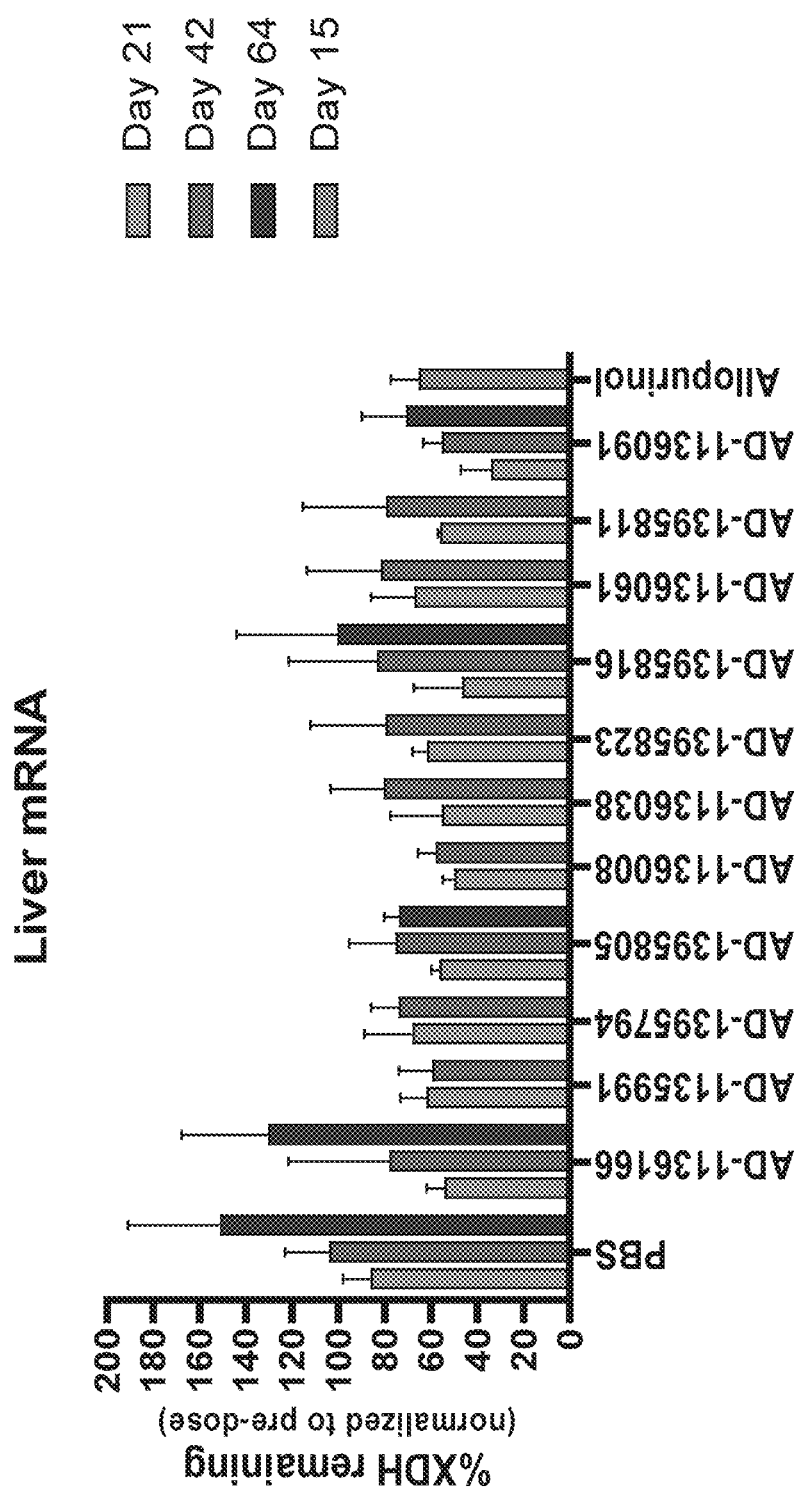
FIG. 3 depicts the levels of levels of XDH mRNA in liver samples obtained from Cynomolgus monkeys following treatment with the indicated XDH targeting siRNAs or allopurinol.

As shown in FIGS. 2 and 3, the greatest silencing for XDH mRNA was observed on Day 21 post dose with a maximal suppression of 66% observed for the AD-1136091 group. Partial recovery was observed on Days 43 and 64. A greater extent of silencing was observed for liver XDH protein with maximal suppression observed on Days 21 or 43 depending on the duplex tested. Up to a 91% reduction in XDH liver protein level was observed for animals treated with AD-1136091 with partial recovery seen by Day 64 post-dose. These results demonstrate that treatment with the exemplary duplex agents targeting XDH effectively reduced both the mRNA level and the protein level of XDH in vivo.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (2419 sequences)

SEQ ID NO: 1 - DNA, 5715 bp, Homo sapiens
acagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctgg

SEQ ID NO: 2 - DNA, 5715 bp, Homo sapiens
ccagctgacagtttcatttattagtgacatcaagcaccagtccaactatatcatttccactatcctccctccatggccagaaccacagattctctctggcagaaggttggatttatacagtgaaggcatgtgacagtgacacattgtccacccagcaccatgtagggattaaatcaccatttggagcaataaaagggatgtttgttcttcccttgttctctttaccaaccgcagaaacttgaggtgatctcagcagagttcattagacccaggtatcatatgacagtaagaaaaccaagccttagatagctgcagatcctttatgtaactggagttttcaggtcatatatttataggcttttaaagcagaagacgtgagacaaccctttactgcaacccttatgtttgcagtaaaatggatcacaggaaggggaattgacagtccaagatcacaaagatagagacagaagagacagagctaggatgagaacccaggcttcttggctcttctacctctggttgggcttgattttgatagcagcatttttatttctttttttttcttcagagacaagatcttgctcagtcgctcaggcaggagtgcagtggcgcaatcatagctcactgcagcctcaacctcctgagctcaaatgatctctccacctcagcctttcaagtagttgggactacaggcatgcactatcaagaccaactaattaaaaaaattttttttaaagacaggagctctctatgttgcccaggctggtctcaaactgctgggctcaagcaattctcctgccttagcctcccaaagtgctgggattataggggtgagccaccatgccaggactgatagcatcatttctaggtggaaattactttggcttcaaatgtaaagattaaacataatcttttttgtaaatactcaaagagtatttggaatacaaatattctcttcaaagaggaagggaaagaaatctagaacattgtacgtgctcaataattgagttggttggatttttgtattatagagtaatcttgctttatgcagcttcacaaaatcagatccaattaaccttgaatttgtttcattctttattctttccaatgattcaaagatggttagaggatttaaccttaccccactgcctcattgcaaaatttgagtatagattcaaggttatgctttgctgttcattggtttgaaggccaggctttcacaggaaggcacacgatttaaagtaacttcggtttaagcttctagaggtttgtgggaatcctcttcaaaggacagacaccatcagaacttgaggttatacaggctgtccagtaagtggggaatagcacaaacccttcccgaccctattccagatacatgattaaaacagacagaaaatgatcctaattgcatattcaccatttaggcataacagttttgaatttgcttatcattgtgtttacaaattacatttttgatcaaaatcttccattgcattcacttgtcttccaaatcccatcttgacaaatcacaggtctgtcattctgtgactttaatagatccatgttctgtggtatgttcctcctgctccatggaagcccaaaggcagcacaagaagactctgctgaggactctctctttagaccctcacagaccagggtttgcagttttctgggacaccagtgacacacagggtggtgaacttgtccacgcaggcattgcggatcttctccggggtggcagggctgtctagccggaagagttccttcacgttattacctgtgtgctgagctcgagctgcacggatggcatctttgatggcaaagaagatagaagcagccaggaagaggggcggctctccaacagccttcgatgcatagatggccttcttgttggggcagtcgcggagcagggacaccctgaactcaatggggatgctgccaaatgccgggatcttgtaggtgctagggccacgggtgtgcaggctcccctcgggggaatagtgtagctcctctagggtgaagaggccaaggccctggacaaatgccccttccacctgtccaatatcaatggcagggtttagactggagccaacatccatgacaatatctgtgcggaggttcttatgatctcctgttaggcagtcgatttctacttcagagcaagccaccccatagctgaagtagtggaaggggttccctgagttagtctcaaagctgtagcccagattgggtgttctataaaacccagtggcagacaagctcactgtgtccatgtaggcagctgtgacccagtcttcccaggagccactgggattcttcttcttgtagggttccagccttttcaagatggtctgacaagccgcatagacggcctgtccattgaggtcagcgctgacagaggcagccgtgggagaggtgttgggcacagtgttagtgcttgtctcgctgatataaatcttagaggtggggattttcagagctctactggccacctggaccattttggtatgaaggccttggcccatctcagtccccccgtgggtcagcagcacagagccatctgtgtacacatgaagtagggctcctgcctgattcagaaaaggaactgtaaagcttattccaaacttggtgggaattatgcacaatcctctctttttccaacaattctccttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatactctgagagagatcctgggtgttccccacattgctgaagtggtccacctcaagagccacaactgtcccagtcttcatgaagccaaccttgtatctggccaggaagggatgtctgccaccagttatcagcatgtcctcatcacggtccagcatgcatcgcacagggcggccggtcttatatgcagccagggccactgccgtggacaccacagtgctccgggtctccttgcctccaaagcctcctcccattctcttcactcgaaccacaatccggtttgctggaacccccaacatttttgcaacaaagctctgggtcttcatggtgttctgtgtagacacaaagagctccatctcccctgcctcgccttttggaacagcaatggtgcagtgagtctccaggtagaagtgctcttggccaccgatgtatatctcccctgacacaacattatctgcttcggaaaaccccttctttaggtcccctttctcgatcttcagctcaggtccataaaaggagttgttctttatagcatcctcaattgtgataatggctggtagttcttcataggtgattttcaccccttgggcagctctctgtgtgtgttccggggtgtcagcaaccacagcaccaatgatatgcccaacacaagtaaccttatccttcgcaaagactgtctcatcattacaaattccagttatgttactcccaggaacatcatcagcggaaatgaaacaaacaaaccctggaaccttcttagcttctgatgtatctatggacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcttggaagagctggacatcggctggggggtctttctgaaacagtaaagttgcactggcgaaagtggggtccagtttaccacacttgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaaggtgtggtccatctggacagttctcctggtgcctctggacacaagtgtcagcttggccccactggccatgaacacggggttgaggtcggagatggggctggcagtgatgatgttccctccaacggacgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagataccgtcgggtccatgttctaccgaattcagctcagggatccaggctgggcagacaatcataggaaacagcatattcttgaacttcatctcaatgccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctcagcaactctgggggaaaaatgggctcctgggttggatccaggggcgtgaactcctctggtttgaataaagatggcgagaggctgactgagtggtctttcttctggttcatgcagcaatttggattattcccatctcctccacagcatccaccatccctggcaaaggtccggaagccctggaggatgggtctgtagcctgtgcagcggcacagatttccttggaaggcattctcaatctcctccatggtgggctcgggctgattccggagcagtgtgtacatactcatgacgatgccaggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccgcagcccccctctccacagccgagcttggttccactcagccccaactttcttctcaggtaggccaaaagggttgtctctggatctgcatttttctccaccacctttctgccattcacaaagaaaaccaatttgtctgctgtcattgtcacaggttggggtccccgaactccaggtacctcactcctaagagacactggcaggtagttatcactgctctgt

SEQ ID NO: 3 - DNA, 4623 bp, Mus musculus
atctttcaagttgcaggcagtgatatctacaagcacctcgcagcagctcggggactccggccgtcacgatgacgaggacaacggtagatgagttggtcttctttgtgaatggcaaaaaggtggtggagaaaaatgcagaccctgaaacaacacttctggtctaccttagaagaaagttggggctgtgcgggaccaagcttggctgtggagaaggtggctgtggggcatgcaccgtgatgatctccaagtatgaccgccttcagaacaagatcgttcatttttccgtcaatgcctgcttgacccccatctgctccttgcatcatgttgctgtgacaactgtggaaggcataggaaacaccaagaagctgcatcctgtccaggagagaattgccaaaagccatggttcccagtgtgggttctgtacccctggtattgtcatgagtatgtacacactgctccgaaacaagcctgagcctactgtcgaggagatcgagaatgccttccaaggaaacctctgccgctgtacaggctatagacccatcctccagggattccggacctttgccaaggatggtgggtgctgtggaggaagtggaaacaacccaaactgctgcatgagccaaacaaaggaccagacgattgctccctcatcttctttattcaacccggaggatttcaaacctttagatcccacccaagagcccatctttcccccagagttgctgaggctgaaagacactccccggaagacgttgcgttttgaaggggaacgtgtgacctggatccaggtttcaaccatggaggaactgcttgacctcaaagcccagcaccctgatgccaagctggtggtgggaaacacagagataggcattgaaatgaaatttaaaaatatgctatttcctctgatcatctgcccagcctggatccttgaactgacctcagtggcacatgggcctgagggaatctcctttggagccgcttgcccccttagcttggtggaaagtgtcctggcggacgcgattgctacacttccagagcagaggacagaggtgttcagaggcgtgatggagcagctgcgctggtttgctggcaagcaggtcaagtccgtggcgtccattggcgggaacatcatcaccgcgagccccatctctgacctcaaccctgtgctcatggccagtcgagccaagctgaccctcgcatctagaggtaccaagagaacggtctggatggaccataccttcttccctggctatagaaggactctgctcagtccagaggagatattggtgtccattgtgatcccctacagcaggaagggtgagtttttctcagccttcaagcaggcctccaggagagaagatgacattgccaaggtgaccagtggcatgagagtcctgttcaagccagggaccactgaagtgcaggaactgtccctttgctttggagggatggctgacagaactgtctcagccctcaagaccactccgaagcagctgtccaagtcctggaatgaggagttgctgcaggatgtgtgtgctggcttggcagaggagctgcacctggcccccgacgcccctggtgggatggtggaattccggcgcaccctcaccctcagcttcttcttcaagttctacctgacagtgcttcagaagctgggcagagcggaccttgagggtatgtgtggtaaactggaccccacctttgccagcgccaccctgctctttcagaaggatcctccagctaacgtccagcttttccaagaggtgcccaagggtcagtctgaggaggacatggtgggcaggcccatgcctcacctggcagcagacatgcaggcatccggggaggctgtgtactgtgatgacattccccgctatgagaatgagctgtccctcaggctggtcaccagcacgcgggcccatgctaaaatcatgtccatcgacacttcagaagccaagaaggtgccagggtttgtttgtttcctcacctcagaggatgtccctggtagtaacataactggcattttcaatgatgaaactgtctttgcgaaggatgaggttacttgtgttgggcacatcattggtgctgtggtcgctgacaccccagaacatgcacacagagccgctagaggggtgaaaatcacctatgaagaccttccagccattatcacaatccaggatgctataaagaacaactccttttatggccccgaggtaaaaatcgagaaaggagatctcaagaaaggcttttctgaagctgacaatgttgtctcaggagaattatatattggtggccaggagcacttctatctggagacccactgcaccattgccgtgccgaaaggcgaggcaggcgagatggagctcttcgtgagcacacagaacaccatgaaaacccagagctttattgcaaagatgttgggtgttccagacaacagaattgtagtccgagtgaaaagaatgggtggaggctttggagggaaggagacccggagcactctgatatccacagcagtggccttggctgcatacaagacaggccgccctgtacgttgcatgctggaccgagacgaggacatgctcataactggtggcagacatcccttcctggctaaatacaaggtgggcttcatgaagactgggactatagtggcactggaggtggctcacttcagcaatggcgggaacagtgaggatctctctcggagtataatggaaagagctgtattccacatggacaacgcctataagatccccaacattcgcggcaccgggaggatttgtaagactaatctgccctctaacacagccttcagaggctttgggggtcctcaggggatgctaatcgcagaatactggatgagtgaggtcgctgtcacctgtgggctgcctgcagaggaggtacggaggaaaaacatgtacaaagaaggggacctgactcacttcaaccagaagctggaggggttcaccttgcccaggtgctgggatgagtgcatagcgagctcccagtatcaggctcgcaagatggaagtggagaaattcaacagggagaactgttggaaaaagagagggctgtgtataatcccgactaagtttggaataagcttcacactttcttttctgaaccaggggggtgccttggtccacgtgtacacggatgggtcggtgctgctgacacatggaggtactgagatgggtcaaggccttcacaccaagatggttcaggtggccagcagagctctgaaaatccccacttccaagatccatataacggagacaagcactaacactgtccctaacacctctcccacggctgcctctgccagcgctgacctcaatggccaggccatttatgaagcctgtcagaccatactgaaaagactggagcccttcaagaaaaagaatccctcaggctcctgggagagctgggtcatggatgcctacactagtgcagtgagcttgtctgctactggattttataagacacccaaccttggttacagctttgagacaaactctgggaaccccttccactacttcagttatggggtggcttgctcagaagtagaaattgactgcttaacaggggaccataagaatctccgtacagatatcgtcatggatgttggttccagcttgaatcctgccattgatatcggacaggtagaaggggcatttgtccagggtcttggtcttttcaccatggaggagctgcactactctcccgaggggagcctgcacactcgtggccccagtacctacaagatccctgcatttggcagcatccccattgagttcagagtatccctgctccgcgactgccccaacaagagggccatctatgcatccaaggctgtcggcgagccacctcttttcctggcttcttcgatcttctttgccatcaaagatgccatccgcgcagctcgagctcagcacggagacagtaacgccaaacagctcttccagctagacagccccgccactccggagaagatccgaaacgcttgtgtggatcagttcaccaccctgtgtgccactggaacaccagaaaactgtaaatcctggtccgtgaggatctgaaaaggaggctccccagtatggttttatactacagccctgattcctcggaatgtcaagtgcataccgtagtatccagatttccacacatcccatggggactcagcaggatggcattttcaagaaaatggacaattgtgatccaaatcatgagttgcaaacaaaccaataagcaaacggggagctgctggcccaagtggcagttttgagtaattctgggtaattctgagtccatttttgatcacatatttgaaatgaggttagcaagggtttgcattatgtccctactcgccacatggcctgtgtaactaagattctcacacacctcctgacgctgaaaccaacgtttctctagatctgcatgctttcttcagagagcttatatctgccaagccaccaagggccgtgttgtaaccgcagctgcacactcatagtcttcagtggaatagtgtgtgtgtgtgtgtgggggggggggattaaaacctccaactgcctttacatcatagaagacaataaaacatgataatgaatgtggggttaaaaaaaaaaa

SEQ ID NO: 4 - DNA, 4623 bp, Mus musculus
tttttttttttaaccccacattcattatcatgttttattgtcttctatgatgtaaaggcagttggaggttttaatcccccccccccacacacacacacacactattccactgaagactatgagtgtgcagctgcggttacaacacggcccttggtggcttggcagatataagctctctgaagaaagcatgcagatctagagaaacgttggtttcagcgtcaggaggtgtgtgagaatcttagttacacaggccatgtggcgagtagggacataatgcaaacccttgctaacctcatttcaaatatgtgatcaaaaatggactcagaattacccagaattactcaaaactgccacttgggccagcagctccccgtttgcttattggtttgtttgcaactcatgatttggatcacaattgtccattttcttgaaaatgccatcctgctgagtccccatgggatgtgtggaaatctggatactacggtatgcacttgacattccgaggaatcagggctgtagtataaaaccatactggggagcctccttttcagatcctcacggaccaggatttacagttttctggtgttccagtggcacacagggtggtgaactgatccacacaagcgtttcggatcttctccggagtggcggggctgtctagctggaagagctgtttggcgttactgtctccgtgctgagctcgagctgcgcggatggcatctttgatggcaaagaagatcgaagaagccaggaaaagaggtggctcgccgacagccttggatgcatagatggccctcttgttggggcagtcgcggagcagggatactctgaactcaatggggatgctgccaaatgcagggatcttgtaggtactggggccacgagtgtgcaggctcccctcgggagagtagtgcagctcctccatggtgaaaagaccaagaccctggacaaatgccccttctacctgtccgatatcaatggcaggattcaagctggaaccaacatccatgacgatatctgtacggagattcttatggtcccctgttaagcagtcaatttctacttctgagcaagccaccccataactgaagtagtggaaggggttcccagagtttgtctcaaagctgtaaccaaggttgggtgtcttataaaatccagtagcagacaagctcactgcactagtgtaggcatccatgacccagctctcccaggagcctgagggattctttttcttgaagggctccagtcttttcagtatggtctgacaggcttcataaatggcctggccattgaggtcagcgctggcagaggcagccgtgggagaggtgttagggacagtgttagtgcttgtctccgttatatggatcttggaagtggggattttcagagctctgctggccacctgaaccatcttggtgtgaaggccttgacccatctcagtacctccatgtgtcagcagcaccgacccatccgtgtacacgtggaccaaggcacccccctggttcagaaaagaaagtgtgaagcttattccaaacttagtcgggattatacacagccctctctttttccaacagttctccctgttgaatttctccacttccatcttgcgagcctgatactgggagctcgctatgcactcatcccagcacctgggcaaggtgaacccctccagcttctggttgaagtgagtcaggtccccttctttgtacatgtttttcctccgtacctcctctgcaggcagcccacaggtgacagcgacctcactcatccagtattctgcgattagcatcccctgaggacccccaaagcctctgaaggctgtgttagagggcagattagtcttacaaatcctcccggtgccgcgaatgttggggatcttataggcgttgtccatgtggaatacagctctttccattatactccgagagagatcctcactgttcccgccattgctgaagtgagccacctccagtgccactatagtcccagtcttcatgaagcccaccttgtatttagccaggaagggatgtctgccaccagttatgagcatgtcctcgtctcggtccagcatgcaacgtacagggcggcctgtcttgtatgcagccaaggccactgctgtggatatcagagtgctccgggtctccttccctccaaagcctccacccattcttttcactcggactacaattctgttgtctggaacacccaacatctttgcaataaagctctgggttttcatggtgttctgtgtgctcacgaagagctccatctcgcctgcctcgcctttcggcacggcaatggtgcagtgggtctccagatagaagtgctcctggccaccaatatataattctcctgagacaacattgtcagcttcagaaaagcctttcttgagatctcctttctcgatttttacctcggggccataaaaggagttgttctttatagcatcctggattgtgataatggctggaaggtcttcataggtgattttcacccctctagcggctctgtgtgcatgttctggggtgtcagcgaccacagcaccaatgatgtgcccaacacaagtaacctcatccttcgcaaagacagtttcatcattgaaaatgccagttatgttactaccagggacatcctctgaggtgaggaaacaaacaaaccctggcaccttcttggcttctgaagtgtcgatggacatgattttagcatgggcccgcgtgctggtgaccagcctgagggacagctcattctcatagcggggaatgtcatcacagtacacagcctccccggatgcctgcatgtctgctgccaggtgaggcatgggcctgcccaccatgtcctcctcagactgacccttgggcacctcttggaaaagctggacgttagctggaggatccttctgaaagagcagggtggcgctggcaaaggtggggtccagtttaccacacataccctcaaggtccgctctgcccagcttctgaagcactgtcaggtagaacttgaagaagaagctgagggtgagggtgcgccggaattccaccatcccaccaggggcgtcgggggccaggtgcagctcctctgccaagccagcacacacatcctgcagcaactcctcattccaggacttggacagctgcttcggagtggtcttgagggctgagacagttctgtcagccatccctccaaagcaaagggacagttcctgcacttcagtggtccctggcttgaacaggactctcatgccactggtcaccttggcaatgtcatcttctctcctggaggcctgcttgaaggctgagaaaaactcacccttcctgctgtaggggatcacaatggacaccaatatctcctctggactgagcagagtccttctatagccagggaagaaggtatggtccatccagaccgttctcttggtacctctagatgcgagggtcagcttggctcgactggccatgagcacagggttgaggtcagagatggggctcgcggtgatgatgttcccgccaatggacgccacggacttgacctgcttgccagcaaaccagcgcagctgctccatcacgcctctgaacacctctgtcctctgctctggaagtgtagcaatcgcgtccgccaggacactttccaccaagctaagggggcaagcggctccaaaggagattccctcaggcccatgtgccactgaggtcagttcaaggatccaggctgggcagatgatcagaggaaatagcatatttttaaatttcatttcaatgcctatctctgtgtttcccaccaccagcttggcatcagggtgctgggctttgaggtcaagcagttcctccatggttgaaacctggatccaggtcacacgttccccttcaaaacgcaacgtcttccggggagtgtctttcagcctcagcaactctgggggaaagatgggctcttgggtgggatctaaaggtttgaaatcctccgggttgaataaagaagatgagggagcaatcgtctggtcctttgtttggctcatgcagcagtttgggttgtttccacttcctccacagcacccaccatccttggcaaaggtccggaatccctggaggatgggtctatagcctgtacagcggcagaggtttccttggaaggcattctcgatctcctcgacagtaggctcaggcttgtttcggagcagtgtgtacatactcatgacaataccaggggtacagaacccacactgggaaccatggcttttggcaattctctcctggacaggatgcagcttcttggtgtttcctatgccttccacagttgtcacagcaacatgatgcaaggagcagatgggggtcaagcaggcattgacggaaaaatgaacgatcttgttctgaaggcggtcatacttggagatcatcacggtgcatgccccacagccaccttctccacagccaagcttggtcccgcacagccccaactttcttctaaggtagaccagaagtgttgtttcagggtctgcatttttctccaccacctttttgccattcacaaagaagaccaactcatctaccgttgtcctcgtcatcgtgacggccggagtccccgagctgctgcgaggtgcttgtagatatcactgcctgcaacttgaaagat

SEQ ID NO: 5 - DNA, 4198 bp, Rattus norvegicus
agagctcagtgactccagcagccacgatgactgcggatgagttggtcttctttgtgaatggcaaaaaggtggtggagaaaaatgcggaccctgaaacaacacttctggtctacctgagaagaaagttggggctatgtgggaccaagcttggctgtggagaaggtggctgtggggcatgcaccgtgatgatctccaagtatgaccgtcttcagaacaagattgttcatttttctgtcaatgcctgcttggctcccatctgctccttgcaccatgttgctgtgaccaccgtggaaggcataggaaacacccagaagctgcatcctgtacaggagagaattgccagaagccatggttcccagtgtgggttctgcactcctggcattgtcatgagtatgtacacactgctccggaaccagcctgagcctactgttgaggagatcgagaatgccttccaaggaaacctctgtcgctgtacaggctacagacccatcctccagggattccggacctttgccaaggatggtgggtgctgtggagggagtggaaacaacccaaactgctgtatgaaccagacgaaagaccaaacggtttctctctcaccttctttattcaacccagaggatttcaaacctttagatcccacgcaagagcccatcttccccccagagttgctgaggctgaaagacactccccagaagaagctgcgttttgaaggggaacgtgtgacctggatccaggcttcaactatggaggagctgcttgacctgaaagctcagcaccctgatgccaagctggtggtgggaaacacagagataggcattgaaatgaaatttaagaatatgctatttcctctgatcgtctgcccagcctggatccctgaactgaattcagtggtgcatgggcctgagggaatctccttcggagcttcttgcccccttagcttggtggaaagtgtcctggcggaggagattgctaaacttccagagcaaaagacagaggtgttcagaggcgtgatggagcagctgcgctggtttgccggcaagcaggtcaagtccgtggcgtccatcggagggaacatcatcactgccagccccatctctgacctcaaccctgtgttcatggccagtggagccaagctgactctggtgtctagaggtaccaggagaactgttcggatggatcataccttcttccctggctacagaaagactctgctcagaccagaggagatattgctgtccatcgagatcccctatagcaaggagggagagtttttctcagccttcaagcaggcctccaggagggaagatgacattgccaaggtgactagtggcatgagagtcctgttcaaaccggggaccattgaagtgcaggaactgtccctttgcttcggagggatggccgacagaactatctcagccctcaagaccactccgaagcagctatcgaagtcctggaatgaggagctgctgcagagcgtgtgtgccggcttggcagaggagctgcagctggcccccgatgcccctggtggtatggtggaattccggcgcaccctcaccctcagcttcttcttcaagttctacctgacagtgctccagaagctgggcagagcggaccttgaggatatgtgtggtaaactggaccccacctttgccagtgccaccctgctctttcagaaggaccctccagctaatgtccagcttttccaagaggtgccaaaggatcagtctgaggaggacatggtgggccggcccctgcctcacctggcggcaaacatgcaggcatcgggagaggccgtgtactgtgatgacattccccgctatgagaatgagctctctctcaggctggtcaccagcacccgggcgcatgctaaaatcacgtccatcgacacttcagaagccaagaaggtgccagggtttgtttgcttcctcaccgcagaggatgtccctaatagtaatgcaaccggccttttcaatgatgaaactgtctttgcgaaggatgaggttacttgtgttgggcacatcattggtgctgtggtcgctgacaccccagaacacgcacagagagctgcgagaggggtgaaaatcacctatgaagatcttccagccattatcacaatccaggatgctataaacaacaactccttttatggctctgagataaaaattgagaaaggagatctcaagaaaggcttttcagaagctgacaatgttgtctcaggagagttgtatatcggtggccaggagcacttctacctggagaccaactgcaccattgccgtgccaaaaggcgaggcaggcgagatggagctgttcgtgagcacacagaacaccatgaaaacccagagctttgttgcaaaaatgttgggcgttccggacaacagaatcgtagtccgagtgaagaggatgggtggaggctttggagggaaggagacccggagcactgtggtgtccacagcactggccttggctgcacacaagactggccggcccgtacgttgcatgttggaccgagatgaggacatgctgataactggtggcagacatcccttcctggctaaatacaaggttggcttcatgaagactgggactgtagtggctctcgaggtggctcacttcagcaatggtggtaacactgaggatctctctcggagtataatggaacgagctttgttccacatggataacgcctataagatccccaacattcgaggcactgggaggatttgcaagactaatctgccctccaacacagccttcagaggttttgggggtcctcaggggatgctaatcgcagaatactggatgagcgaggtcgccataacctgtgggctgcctgcagaggaggtacggaggaaaaacatgtacaaagaaggggacctgactcacttcaaccagaagctggaggggttcaccttgcccaggtgctgggatgaatgcatcgccagctctcagtatcttgctcgcaagagggaagtggagaaattcaacagggagaattgttggaaaaagagagggctgtgtataatcccaactaagtttggaataagctttacacttccttttctgaaccagggaggcgctctggttcacgtgtacactgatggttcggtgctgttgacccatggagggactgagatgggccaaggccttcacaccaagatggttcaggtggccagcagagctctgaaaatccccacctccaagattcatataagtgagacaagcactaacaccgtccccaacacttctcccacagctgcctctgccagtgctgacctcaatggacagggtgtttatgaagcatgccagaccatactgaaaaggctggaacctttcaagaagaagaaacccaccggcccctgggaggcatgggtgatggacgcctatacgagcgcagtgagtttgtccgcaactggattttataagacacccaaccttggctacagctttgagacaaactccggaaatcccttccactatttcagttatggggtggcttgctctgaagtagaaattgactgcttaacaggggatcataagaatctccgtacggatatcgtcatggatgttggttccagcttgaatcctgccattgatattggacaagtagagggggcatttgtccagggccttggtctcttcactatggaggagctgcactactcccctgaggggagcctgcatactcgtggccccagtacctacaaaatccctgcatttggtagcatccccattgagttcagagtatccctactccgggactgccccaacaagagggccatctatgcatccaaggctgttggggagccacctcttttcctggcttcctctatcttctttgccatcaaagatgccattcgtgcagctcgagctcagcacggagataacgcaaaacaacttttccagctagacagccctgccactccggagaagatccgaaacgcctgtgtggaccagttcaccaccctgtgtgtcactggagtaccagaaaactgtaaatcctggtctgtgaggatctgaagagaaggtctccaccattggtttgtaccgcaccaggattccttggagccacaagcacatcctgtagtatccagatttccgcatgccgcgtgggactcagcaggatgacattttcaggaagatggacattttgacccaaataagagctgcaaacaaaccaataagcaaatggggag

SEQ ID NO: 6 - DNA, 4198 bp, Rattus norvegicus
ctccccatttgcttattggtttgtttgcagctcttatttgggtcaaaatgtccatcttcctgaaaatgtcatcctgctgagtcccacgcggcatgcggaaatctggatactacaggatgtgcttgtggctccaaggaatcctggtgcggtacaaaccaatggtggagaccttctcttcagatcctcacagaccaggatttacagttttctggtactccagtgacacacagggtggtgaactggtccacacaggcgtttcggatcttctccggagtggcagggctgtctagctggaaaagttgttttgcgttatctccgtgctgagctcgagctgcacgaatggcatctttgatggcaaagaagatagaggaagccaggaaaagaggtggctccccaacagccttggatgcatagatggccctcttgttggggcagtcccggagtagggatactctgaactcaatggggatgctaccaaatgcagggattttgtaggtactggggccacgagtatgcaggctcccctcaggggagtagtgcagctcctccatagtgaagagaccaaggccctggacaaatgccccctctacttgtccaatatcaatggcaggattcaagctggaaccaacatccatgacgatatccgtacggagattcttatgatcccctgttaagcagtcaatttctacttcagagcaagccaccccataactgaaatagtggaagggatttccggagtttgtctcaaagctgtagccaaggttgggtgtcttataaaatccagttgcggacaaactcactgcgctcgtataggcgtccatcacccatgcctcccaggggccggtgggtttcttcttcttgaaaggttccagccttttcagtatggtctggcatgcttcataaacaccctgtccattgaggtcagcactggcagaggcagctgtgggagaagtgttggggacggtgttagtgcttgtctcacttatatgaatcttggaggtggggattttcagagctctgctggccacctgaaccatcttggtgtgaaggccttggcccatctcagtccctccatgggtcaacagcaccgaaccatcagtgtacacgtgaaccagagcgcctccctggttcagaaaaggaagtgtaaagcttattccaaacttagttgggattatacacagccctctctttttccaacaattctccctgttgaatttctccacttccctcttgcgagcaagatactgagagctggcgatgcattcatcccagcacctgggcaaggtgaacccctccagcttctggttgaagtgagtcaggtccccttctttgtacatgtttttcctccgtacctcctctgcaggcagcccacaggttatggcgacctcgctcatccagtattctgcgattagcatcccctgaggacccccaaaacctctgaaggctgtgttggagggcagattagtcttgcaaatcctcccagtgcctcgaatgttggggatcttataggcgttatccatgtggaacaaagctcgttccattatactccgagagagatcctcagtgttaccaccattgctgaagtgagccacctcgagagccactacagtcccagtcttcatgaagccaaccttgtatttagccaggaagggatgtctgccaccagttatcagcatgtcctcatctcggtccaacatgcaacgtacgggccggccagtcttgtgtgcagccaaggccagtgctgtggacaccacagtgctccgggtctccttccctccaaagcctccacccatcctcttcactcggactacgattctgttgtccggaacgcccaacatttttgcaacaaagctctgggttttcatggtgttctgtgtgctcacgaacagctccatctcgcctgcctcgccttttggcacggcaatggtgcagttggtctccaggtagaagtgctcctggccaccgatatacaactctcctgagacaacattgtcagcttctgaaaagcctttcttgagatctcctttctcaatttttatctcagagccataaaaggagttgttgtttatagcatcctggattgtgataatggctggaagatcttcataggtgattttcacccctctcgcagctctctgtgcgtgttctggggtgtcagcgaccacagcaccaatgatgtgcccaacacaagtaacctcatccttcgcaaagacagtttcatcattgaaaaggccggttgcattactattagggacatcctctgcggtgaggaagcaaacaaaccctggcaccttcttggcttctgaagtgtcgatggacgtgattttagcatgcgcccgggtgctggtgaccagcctgagagagagctcattctcatagcggggaatgtcatcacagtacacggcctctcccgatgcctgcatgtttgccgccaggtgaggcaggggccggcccaccatgtcctcctcagactgatcctttggcacctcttggaaaagctggacattagctggagggtccttctgaaagagcagggtggcactggcaaaggtggggtccagtttaccacacatatcctcaaggtccgctctgcccagcttctggagcactgtcaggtagaacttgaagaagaagctgagggtgagggtgcgccggaattccaccataccaccaggggcatcgggggccagctgcagctcctctgccaagccggcacacacgctctgcagcagctcctcattccaggacttcgatagctgcttcggagtggtcttgagggctgagatagttctgtcggccatccctccgaagcaaagggacagttcctgcacttcaatggtccccggtttgaacaggactctcatgccactagtcaccttggcaatgtcatcttccctcctggaggcctgcttgaaggctgagaaaaactctccctccttgctataggggatctcgatggacagcaatatctcctctggtctgagcagagtctttctgtagccagggaagaaggtatgatccatccgaacagttctcctggtacctctagacaccagagtcagcttggctccactggccatgaacacagggttgaggtcagagatggggctggcagtgatgatgttccctccgatggacgccacggacttgacctgcttgccggcaaaccagcgcagctgctccatcacgcctctgaacacctctgtcttttgctctggaagtttagcaatctcctccgccaggacactttccaccaagctaagggggcaagaagctccgaaggagattccctcaggcccatgcaccactgaattcagttcagggatccaggctgggcagacgatcagaggaaatagcatattcttaaatttcatttcaatgcctatctctgtgtttcccaccaccagcttggcatcagggtgctgagctttcaggtcaagcagctcctccatagttgaagcctggatccaggtcacacgttccccttcaaaacgcagcttcttctggggagtgtctttcagcctcagcaactctggggggaagatgggctcttgcgtgggatctaaaggtttgaaatcctctgggttgaataaagaaggtgagagagaaaccgtttggtctttcgtctggttcatacagcagtttgggttgtttccactccctccacagcacccaccatccttggcaaaggtccggaatccctggaggatgggtctgtagcctgtacagcgacagaggtttccttggaaggcattctcgatctcctcaacagtaggctcaggctggttccggagcagtgtgtacatactcatgacaatgccaggagtgcagaacccacactgggaaccatggcttctggcaattctctcctgtacaggatgcagcttctgggtgtttcctatgccttccacggtggtcacagcaacatggtgcaaggagcagatgggagccaagcaggcattgacagaaaaatgaacaatcttgttctgaagacggtcatacttggagatcatcacggtgcatgccccacagccaccttctccacagccaagcttggtcccacatagccccaactttcttctcaggtagaccagaagtgttgtttcagggtccgcatttttctccaccacctttttgccattcacaaagaagaccaactcatccgcagtcatcgtggctgctggagtcactgagctct

SEQ ID NO: 7 - DNA, 5694 bp, Macaca fascicularis
cattttattgggaggcataattttcaggttacagagcagtgataactacctgccagtgtctcttaggagtgaggtacctggagttgagggaccccaacctgtggcaatgacagcggacgagttggttttctttgtgaacggcagaaaggtggtggagaaaaatgcagatccagagacaacccttttggcctacctgagaagaaggttggggctgagtggaaccaagctcggctgtggagagggaggctgtggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccccggcatcgtcatgagtatgtacacactgctccggaatcagcctgagcccaccatggaggagattgagaatgccttccaaggaaatctgtgccgctgcacaggctacagacccatcctccagggcttccggacctttgccaggggtggtggatgctgtgaaggagatgggaacaatccaaactgctgcatgagccagaagaaagaccactcggtcagtctctcaccatctttattcaagccagaggagttcacgcccctggatcccacccaggagcccatttttcccccagagttgctgaggttgaaagacactcctcggaagcagctgcgatttgaaggggagcgtgtgacgtggatacaggcctcaaccctcaaggagctgctggacctcaaggctcagtaccctgatgccaagctggtggtggggaacacggagattggcattgagatgaagttcaagaatatgctgtttcctatgatcgtctgcccagcttggatccctgagctgaattcagtagaacatggacccgagggtatctccttcggagctgcttgccccctgagcattgtggaaaagaccctggttgatgccattgctaagcttcctgcccaaaagacggaggtgttcagaggggtcctggagcagctgcgctggtttgctgggaagcaggtcaagtctgtggcgtccattggagggaacatcatcactgccagccccatctccgacctcaaccctgtgttcatggccagtggggccaagctgacacttgtgtccagaggcaccaggagaactgttccaatggaccacacattcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtagaggagctggccctttgctatggcggaatggccgacagaaccatctcggccctcaagaccactcagaggcagctttccaagctctggaccgaggagctgctgcaggacgtgtgtgcggccctggcggaggagctgcatctgcctcccgacgcccctggtggcatggtggacttccggcgcaccctcaccctcagcttcttcttcaagttctacctgacagtccttcggaagctgggccaagagaacccagaggacaaatgtggtaaactggaccccacgttcgccagtgcaactttactctttcagaaagacccgccagccaatgtccatctcttccaagaggtgcccaagggccagtctgaggaggacatggtgggccggcccctgccccacctggcagcgaacatgcaggcctctggtgaggccgtgtactgtgacgacatccctcgctatgagaatgagctgtctctccggctggtcaccagcacccgggcccacgccaagatcaagtccatagacatatcagaagccaagaaggtgccagggtttgtttgtttcatttccgctgatgatattcctgggagtaacataactggaatttgtaacgatgagacagtctttgcaaaggataaggttacttgtgttgggcatatcattggtgctgtggttgctgacaccccagaacacacacagagagctgcccaaggggtgaaaatcacctatgaagaactaccagccattatcacaattgaggatgctataaataacaactccttttatggacctgagctgaagatcgagaaaggggacctcaagaaggggttttccgaagcagataatgttgtgtcaggggagttatacatcggtggccaagagcacttctacctggagactcactgcaccattgctgttccaaaaggcgaggaaggagagatggagctctttgtgtctacacagaacaccatgaagacacagagctttgttgcaaaaatgttgggagttccagaaaaccggattgtggttcgagtgaagagaatcggaggaggctttggagggaaggagacccggagcactctggtgtccacggcggtggccctggccgcatataagactggccgccctgtgcgctgcatgctggaccgtgatgaggacatgctgataactggtggcagacatcccttcctggccagatacaaggttggcttcatgaagactgggaaggttgtggctctggaggtggatcacttcagcaacggggggaacacccaggatctctctcagagtattatggaacgagctctattccacatggacaactgctataaaattcccaacatccggggcactgggcggctgtgcaaaaccaaccttccctccaacacggccttccggggctttgggggtccccaggggatgctcattgccgagtattggatgagtgaagttgcggtgacctgtgggatgcctgcagaggaggtgcggatgaaaaacctgtacaaagaaggggacctgacacacttcaaccagaagcttgagagtttcaccttgcccaggtgctgggaagaatgcctagcaagctctcagtatcatgctcggaagagtgaggttgacaagttcaacaaggagaattgttggaaaaagagaggattgtacataattcccaccaagtttggaataagcttcacacttccttttctgaatcaggcaggagccctgcttcatgtgtacacagatggctctgtgctgctgacccatggagggaccgagatgggccaaggccttcataccaaaatggtccaggtggccagcagagctctgaaaatccccacctctaagatttatatcagtgagacaagcactaacactgtgcccaacacttctcccacggctgcctctgtcagcgctgacctcaatggacaagccgtctacgcggcttgtcagaccatcttgaaaaggctggaaccctacaagaagaagaatcccagtggctcctgggaagactgggtcacagctgcctacacggacacagtgagcttgtctgccactgggttttatagaacacccaatctgggctacagctttgagactaactcagggaaccctttccactacttcagctatggggtggcttgctctgaagtagaaattgactgcttaacaggagatcataagaacctccgcacagatattgtcatggatgttggctccagtctaaaccctgccattgatattggacaggtggaaggggcatttgtccagggccttggccttttcaccctagaggagctacactactcccccgaggggagcctgcacacccgcggccctagcacttacaagatcccggcatttggcagcatccccattgagttcagggtgtccctgctccgagactgccccaacaagaaggccatctatgcatcaaaggctgttggagagccacccctcttcctggctgcttctatcttctttgccatcaaagatgccatccgtgcagctcgagctcagcacacaggtaataacgtgaaggaactcttccggctagacagccctgccaccccggagaagatccgcaacgcctgcgtggacaggttcaccaccctgtgtgtcactggtgtaccagaaaactgcaaaccctggtctgtgagggtctgaagagagagtcctcagcagagtcttcctgtgctgcatttgggcttccatggagcaggaggaacataccacagaacatggatctattaaagtcacagaaggacagtgactaattctgtgacttttcatcctaattcatcaggatggcatttggaagacaagtgaatgcattgggagattttgattaaaatgtaatttataaacagaatgataagcaaattcaaaactgttaggcctaaatggtgaatatgcaattagggtcattttctgtctgttctaatcatgtatttggaatagggtcaggaagggtttgtgctattccccacttactggacagcctgtataacctcaagttctgatggtgtctgtccttcaaaagggactcccacaaacctctagaagcttaaaccaaagttactttaaattgtgtgccttcctctgaaagccttgccttcaaaccaatgaacagcaaagcataaccttgaatctatactcaaattttgcagtgaggcagtggggtaagattaaatcctctaaccatctttgaatcattggaaagaataaagaatgaaacaaattcaaggttaattgaatctaattttgttaagctgcataaagcaagattactctataacacaaaaatccaaccaactcaattattgagcacctacaatgttctagatttctttcccttcctctttgagtatttacaaaaaaagattatgtttaatctttacatttgaagccaaagtaatttccacctagaaatgatgctagcaggcctggcatggtggctcacgcctgtaatcccagcactttgggaggctgaggcaggagaattgcttgagcccagcagtttgagaccagcctgggcaacatagagagctcctgtcgtctggatagtgcatgcctgtagtctcaactactagaaaggctgaggtggagagatcatttgagttcaggaggttgagactgcagtgagctgtgactgcacccttgcactcctgcctgagctactgagcaagatcttgtctctgaagaaaaaaaaaagaaataaaaatgctgctgtcaaaatcaagctcaaccagaggtagaagagccaagaagcctgagttctcatcccagctctgtctcttctgtctctagctttgtgatcttggactgtcatttccccttcctgtgatccattttactgcagtaaaggttgtctcctgtcttctgctttaaaagtctataaatatatgacctgaaaactccagttacgtaagggatctgcagctatctaaggcttggttttcttactgtcatatgatacctgggcctgatgaactctgcttagatcccctcaagtttctgcggttggtaaagagaacaagggaagaacaagcatcccttttattgctctaagaggtgatttaatccctacatggtgctgagtggacagtgtgtcactgttgcatgccttcactctataaatccaaccttctgccagacagaatctgtggttctgtccatggagggaggataatggaaatgatatagttggactggtgcttgatgtcactaataaatgaaactgtcagcttgtt

SEQ ID NO: 8 - DNA, 5694 bp, Macaca fascicularis
aacaagctgacagtttcatttattagtgacatcaagcaccagtccaactatatcatttccattatcctccctccatggacagaaccacagattctgtctggcagaaggttggatttatagagtgaaggcatgcaacagtgacacactgtccactcagcaccatgtagggattaaatcacctcttagagcaataaaagggatgcttgttcttcccttgttctctttaccaaccgcagaaacttgaggggatctaagcagagttcatcaggcccaggtatcatatgacagtaagaaaaccaagccttagatagctgcagatcccttacgtaactggagttttcaggtcatatatttatagacttttaaagcagaagacaggagacaacctttactgcagtaaaatggatcacaggaaggggaaatgacagtccaagatcacaaagctagagacagaagagacagagctgggatgagaactcaggcttcttggctcttctacctctggttgagcttgattttgacagcagcatttttatttcttttttttttcttcagagacaagatcttgctcagtagctcaggcaggagtgcaagggtgcagtcacagctcactgcagtctcaacctcctgaactcaaatgatctctccacctcagcctttctagtagttgagactacaggcatgcactatccagacgacaggagctctctatgttgcccaggctggtctcaaactgctgggctcaagcaattctcctgcctcagcctcccaaagtgctgggattacaggcgtgagccaccatgccaggcctgctagcatcatttctaggtggaaattactttggcttcaaatgtaaagattaaacataatctttttttgtaaatactcaaagaggaagggaaagaaatctagaacattgtaggtgctcaataattgagttggttggatttttgtgttatagagtaatcttgctttatgcagcttaacaaaattagattcaattaaccttgaatttgtttcattctttattctttccaatgattcaaagatggttagaggatttaatcttaccccactgcctcactgcaaaatttgagtatagattcaaggttatgctttgctgttcattggtttgaaggcaaggctttcagaggaaggcacacaatttaaagtaactttggtttaagcttctagaggtttgtgggagtcccttttgaaggacagacaccatcagaacttgaggttatacaggctgtccagtaagtggggaatagcacaaacccttcctgaccctattccaaatacatgattagaacagacagaaaatgaccctaattgcatattcaccatttaggcctaacagttttgaatttgcttatcattctgtttataaattacattttaatcaaaatctcccaatgcattcacttgtcttccaaatgccatcctgatgaattaggatgaaaagtcacagaattagtcactgtccttctgtgactttaatagatccatgttctgtggtatgttcctcctgctccatggaagcccaaatgcagcacaggaagactctgctgaggactctctcttcagaccctcacagaccagggtttgcagttttctggtacaccagtgacacacagggtggtgaacctgtccacgcaggcgttgcggatcttctccggggtggcagggctgtctagccggaagagttccttcacgttattacctgtgtgctgagctcgagctgcacggatggcatctttgatggcaaagaagatagaagcagccaggaagaggggtggctctccaacagcctttgatgcatagatggccttcttgttggggcagtctcggagcagggacaccctgaactcaatggggatgctgccaaatgccgggatcttgtaagtgctagggccgcgggtgtgcaggctcccctcgggggagtagtgtagctcctctagggtgaaaaggccaaggccctggacaaatgccccttccacctgtccaatatcaatggcagggtttagactggagccaacatccatgacaatatctgtgcggaggttcttatgatctcctgttaagcagtcaatttctacttcagagcaagccaccccatagctgaagtagtggaaagggttccctgagttagtctcaaagctgtagcccagattgggtgttctataaaacccagtggcagacaagctcactgtgtccgtgtaggcagctgtgacccagtcttcccaggagccactgggattcttcttcttgtagggttccagccttttcaagatggtctgacaagccgcgtagacggcttgtccattgaggtcagcgctgacagaggcagccgtgggagaagtgttgggcacagtgttagtgcttgtctcactgatataaatcttagaggtggggattttcagagctctgctggccacctggaccattttggtatgaaggccttggcccatctcggtccctccatgggtcagcagcacagagccatctgtgtacacatgaagcagggctcctgcctgattcagaaaaggaagtgtgaagcttattccaaacttggtgggaattatgtacaatcctctctttttccaacaattctccttgttgaacttgtcaacctcactcttccgagcatgatactgagagcttgctaggcattcttcccagcacctgggcaaggtgaaactctcaagcttctggttgaagtgtgtcaggtccccttctttgtacaggtttttcatccgcacctcctctgcaggcatcccacaggtcaccgcaacttcactcatccaatactcggcaatgagcatcccctggggacccccaaagccccggaaggccgtgttggagggaaggttggttttgcacagccgcccagtgccccggatgttgggaattttatagcagttgtccatgtggaatagagctcgttccataatactctgagagagatcctgggtgttccccccgttgctgaagtgatccacctccagagccacaaccttcccagtcttcatgaagccaaccttgtatctggccaggaagggatgtctgccaccagttatcagcatgtcctcatcacggtccagcatgcagcgcacagggcggccagtcttatatgcggccagggccaccgccgtggacaccagagtgctccgggtctccttccctccaaagcctcctccgattctcttcactcgaaccacaatccggttttctggaactcccaacatttttgcaacaaagctctgtgtcttcatggtgttctgtgtagacacaaagagctccatctctccttcctcgccttttggaacagcaatggtgcagtgagtctccaggtagaagtgctcttggccaccgatgtataactcccctgacacaacattatctgcttcggaaaaccccttcttgaggtcccctttctcgatcttcagctcaggtccataaaaggagttgttatttatagcatcctcaattgtgataatggctggtagttcttcataggtgattttcaccccttgggcagctctctgtgtgtgttctggggtgtcagcaaccacagcaccaatgatatgcccaacacaagtaaccttatcctttgcaaagactgtctcatcgttacaaattccagttatgttactcccaggaatatcatcagcggaaatgaaacaaacaaaccctggcaccttcttggcttctgatatgtctatggacttgatcttggcgtgggcccgggtgctggtgaccagccggagagacagctcattctcatagcgagggatgtcgtcacagtacacggcctcaccagaggcctgcatgttcgctgccaggtggggcaggggccggcccaccatgtcctcctcagactggcccttgggcacctcttggaagagatggacattggctggcgggtctttctgaaagagtaaagttgcactggcgaacgtggggtccagtttaccacatttgtcctctgggttctcttggcccagcttccgaaggactgtcaggtagaacttgaagaagaagctgagggtgagggtgcgccggaagtccaccatgccaccaggggcgtcgggaggcagatgcagctcctccgccagggccgcacacacgtcctgcagcagctcctcggtccagagcttggaaagctgcctctgagtggtcttgagggccgagatggttctgtcggccattccgccatagcaaagggccagctcctctacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaatgtgtggtccattggaacagttctcctggtgcctctggacacaagtgtcagcttggccccactggccatgaacacagggttgaggtcggagatggggctggcagtgatgatgttccctccaatggacgccacagacttgacctgcttcccagcaaaccagcgcagctgctccaggacccctctgaacacctccgtcttttgggcaggaagcttagcaatggcatcaaccagggtcttttccacaatgctcagggggcaagcagctccgaaggagataccctcgggtccatgttctactgaattcagctcagggatccaagctgggcagacgatcataggaaacagcatattcttgaacttcatctcaatgccaatctccgtgttccccaccaccagcttggcatcagggtactgagccttgaggtccagcagctccttgagggttgaggcctgtatccacgtcacacgctccccttcaaatcgcagctgcttccgaggagtgtctttcaacctcagcaactctgggggaaaaatgggctcctgggtgggatccaggggcgtgaactcctctggcttgaataaagatggtgagagactgaccgagtggtctttcttctggctcatgcagcagtttggattgttcccatctccttcacagcatccaccacccctggcaaaggtccggaagccctggaggatgggtctgtagcctgtgcagcggcacagatttccttggaaggcattctcaatctcctccatggtgggctcaggctgattccggagcagtgtgtacatactcatgacgatgccgggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccacagcctccctctccacagccgagcttggttccactcagccccaaccttcttctcaggtaggccaaaagggttgtctctggatctgcatttttctccaccacctttctgccgttcacaaagaaaaccaactcgtccgctgtcattgccacaggttggggtccctcaactccaggtacctcactcctaagagacactggcaggtagttatcactgctctgtaacctgaaaattatgcctcccaataaaatg

SEQ ID NO: 9 - DNA, 3511 bp, Homo sapiens
tcaggtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggagttggccaggtgacctctgaggacattgctattaccaacattctcagtgtgtgaggcgggcatgctctgtgtgtaaaggtcgcgagtttcccacattccaagactcctcggagtggagtgaggacaatgagctggattagagtcagcacatctgcttggcgcatggagactggccagattggatcttttgaaaagtgagtgttagtgtaaaaaggcactgtttgtcagtttatgaattttttatccaaccgaactccaccaagtgctccttcaaattca

SEQ ID NO: 10 - DNA, 3511 bp, Homo sapiens
tgaatttgaaggagcacttggtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtcctcagaggtcacctggccaactcctggaccattttggtatgaaggccttggcccatctcagtccccccgtgggtcagcagcacagagccatctgtgtacacatgaagtagggctcctgcctgattcagaaaaggaactgtaaagcttattccaaacttggtgggaattatgcacaatcctctctttttccaacaattctccttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatactctgagagagatcctgggtgttccccacattgctgaagtggtccacctcaagagccacaactgtcccagtcttcatgaagccaaccttgtatctggccaggaagggatgtctgccaccagttatcagcatgtcctcatcacggtccagcatgcatcgcacagggcggccggtcttatatgcagccagggccactgccgtggacaccacagtgctccgggtctccttgcctccaaagcctcctcccattctcttcactcgaaccacaatccggtttgctggaacccccaacatttttgcaacaaagctctgggtcttcatggtgttctgtgtagacacaaagagctccatctcccctgcctcgccttttggaacagcaatggtgcagtgagtctccaggtagaagtgctcttggccaccgatgtatatctcccctgacacaacattatctgcttcggaaaaccccttctttaggtcccctttctcgatcttcagctcaggtccataaaaggagttgttctttatagcatcctcaattgtgataatggctggtagttcttcataggtgattttcaccccttgggcagctctctgtgtgtgttccggggtgtcagcaaccacagcaccaatgatatgcccaacacaagtaaccttatccttcgcaaagactgtctcatcattacaaattccagttatgttactcccaggaacatcatcagcggaaatgaaacaaacaaaccctggaaccttcttagcttctgatgtatctatggacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcttggaagagctggacatcggctggggggtctttctgaaacagtaaagttgcactggcgaaagtggggtccagtttaccacacttgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaaggtgtggtccatctggacagttctcctggtgcctctggacacaagtgtcagcttggccccactggccatgaacacggggttgaggtcggagatggggctggcagtgatgatgttccctccaacggacgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagataccgtcgggtccatgttctaccgaattcagctcagggatccaggctgggcagacaatcataggaaacagcatattcttgaacttcatctcaatgccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctcagcaactctgggggaaaaatgggctcctgggttggatccaggggcgtgaactcctctggtttgaataaagatggcgagaggctgactgagtggtctttcttctggttcatgcagcaatttggattattcccatctcctccacagcatccaccatccctggcaaaggtccggaagccctggaggatgggtctgtagcctgtgcagcggcacagatttccttggaaggcattctcaatctcctccatggtgggctcgggctgattccggagcagtgtgtacatactcatgacgatgccaggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccgcagcccccctctccacagccgagcttggttccactcagccccaactttcttctcaggtaggccaaaagggttgtctctggatctgcatttttctccaccacctttctgccattcacaaagaaaaccaatttgtctgctgtcattgtcacaggttggggtccccgaactccaggtacctcactcctaagagacactggcaggtagttatcactgctctgtgacctga

SEQ ID NO: 11 - DNA, 5717 bp, Homo sapiens
gtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctg

SEQ ID NO: 12 - DNA, 5717 bp, Homo sapiens
cagctgacagtttcatttattagtgacatcaagcaccagtccaactatatcatttccactatcctccctccatggccagaaccacagattctctctggcagaaggttggatttatacagtgaaggcatgtgacagtgacacattgtccacccagcaccatgtagggattaaatcaccatttggagcaataaaagggatgtttgttcttcccttgttctctttaccaaccgcagaaacttgaggtgatctcagcagagttcattagacccaggtatcatatgacagtaagaaaaccaagccttagatagctgcagatcctttatgtaactggagttttcaggtcatatatttataggcttttaaagcagaagacgtgagacaaccctttactgcaacccttatgtttgcagtaaaatggatcacaggaaggggaattgacagtccaagatcacaaagatagagacagaagagacagagctaggatgagaacccaggcttcttggctcttctacctctggttgggcttgattttgatagcagcatttttatttctttttttttcttcagagacaagatcttgctcagtcgctcaggcaggagtgcagtggcgcaatcatagctcactgcagcctcaacctcctgagctcaaatgatctctccacctcagcctttcaagtagttgggactacaggcatgcactatcaagaccaactaattaaaaaaattttttttaaagacaggagctctctatgttgcccaggctggtctcaaactgctgggctcaagcaattctcctgccttagcctcccaaagtgctgggattataggggtgagccaccatgccaggactgatagcatcatttctaggtggaaattactttggcttcaaatgtaaagattaaacataatcttttttgtaaatactcaaagagtatttggaatacaaatattctcttcaaagaggaagggaaagaaatctagaacattgtacgtgctcaataattgagttggttggatttttgtattatagagtaatcttgctttatgcagcttcacaaaatcagatccaattaaccttgaatttgtttcattctttattctttccaatgattcaaagatggttagaggatttaaccttaccccactgcctcattgcaaaatttgagtatagattcaaggttatgctttgctgttcattggtttgaaggccaggctttcacaggaaggcacacgatttaaagtaacttcggtttaagcttctagaggtttgtgggaatcctcttcaaaggacagacaccatcagaacttgaggttatacaggctgtccagtaagtggggaatagcacaaacccttcccgaccctattccagatacatgattaaaacagacagaaaatgatcctaattgcatattcaccatttaggcataacagttttgaatttgcttatcattgtgtttacaaattacatttttgatcaaaatcttccattgcattcacttgtcttccaaatcccatcttgacaaatcacaggtctgtcattctgtgactttaatagatccatgttctgtggtatgttcctcctgctccatggaagcccaaaggcagcacaagaagactctgctgaggactctctctttagaccctcacagaccagggtttgcagttttctgggacaccagtgacacacagggtggtgaacttgtccacgcaggcattgcggatcttctccggggtggcagggctgtctagccggaagagttccttcacgttattacctgtgtgctgagctcgagctgcacggatggcatctttgatggcaaagaagatagaagcagccaggaagaggggcggctctccaacagccttcgatgcatagatggccttcttgttggggcagtcgcggagcagggacaccctgaactcaatggggatgctgccaaatgccgggatcttgtaggtgctagggccacgggtgtgcaggctcccctcgggggaatagtgtagctcctctagggtgaagaggccaaggccctggacaaatgccccttccacctgtccaatatcaatggcagggtttagactggagccaacatccatgacaatatctgtgcggaggttcttatgatctcctgttaggcagtcgatttctacttcagagcaagccaccccatagctgaagtagtggaaggggttccctgagttagtctcaaagctgtagcccagattgggtgttctataaaacccagtggcagacaagctcactgtgtccatgtaggcagctgtgacccagtcttcccaggagccactgggattcttcttcttgtagggttccagccttttcaagatggtctgacaagccgcatagacggcctgtccattgaggtcagcgctgacagaggcagccgtgggagaggtgttgggcacagtgttagtgcttgtctcgctgatataaatcttagaggtggggattttcagagctctactggccacctggaccattttggtatgaaggccttggcccatctcagtccccccgtgggtcagcagcacagagccatctgtgtacacatgaagtagggctcctgcctgattcagaaaaggaactgtaaagcttattccaaacttggtgggaattatgcacaatcctctctttttccaacaattctccttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatactctgagagagatcctgggtgttccccacattgctgaagtggtccacctcaagagccacaactgtcccagtcttcatgaagccaaccttgtatctggccaggaagggatgtctgccaccagttatcagcatgtcctcatcacggtccagcatgcatcgcacagggcggccggtcttatatgcagccagggccactgccgtggacaccacagtgctccgggtctccttgcctccaaagcctcctcccattctcttcactcgaaccacaatccggtttgctggaacccccaacatttttgcaacaaagctctgggtcttcatggtgttctgtgtagacacaaagagctccatctcccctgcctcgccttttggaacagcaatggtgcagtgagtctccaggtagaagtgctcttggccaccgatgtatatctcccctgacacaacattatctgcttcggaaaaccccttctttaggtcccctttctcgatcttcagctcaggtccataaaaggagttgttctttatagcatcctcaattgtgataatggctggtagttcttcataggtgattttcaccccttgggcagctctctgtgtgtgttccggggtgtcagcaaccacagcaccaatgatatgcccaacacaagtaaccttatccttcgcaaagactgtctcatcattacaaattccagttatgttactcccaggaacatcatcagcggaaatgaaacaaacaaaccctggaaccttcttagcttctgatgtatctatggacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcttggaagagctggacatcggctggggggtctttctgaaacagtaaagttgcactggcgaaagtggggtccagtttaccacacttgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaaggtgtggtccatctggacagttctcctggtgcctctggacacaagtgtcagcttggccccactggccatgaacacggggttgaggtcggagatggggctggcagtgatgatgttccctccaacggacgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagataccgtcgggtccatgttctaccgaattcagctcagggatccaggctgggcagacaatcataggaaacagcatattcttgaacttcatctcaatgccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctcagcaactctgggggaaaaatgggctcctgggttggatccaggggcgtgaactcctctggtttgaataaagatggcgagaggctgactgagtggtctttcttctggttcatgcagcaatttggattattcccatctcctccacagcatccaccatccctggcaaaggtccggaagccctggaggatgggtctgtagcctgtgcagcggcacagatttccttggaaggcattctcaatctcctccatggtgggctcgggctgattccggagcagtgtgtacatactcatgacgatgccaggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccgcagcccccctctccacagccgagcttggttccactcagccccaactttcttctcaggtaggccaaaagggttgtctctggatctgcatttttctccaccacctttctgccattcacaaagaaaaccaatttgtctgctgtcattgtcacaggttggggtccccgaactccaggtacctcactcctaagagacactggcaggtagttatcactgctctgtgac

SEQ ID NO: 13-14 - skipped (2 entries)

SEQ ID NO: 15 - DNA, 5691 bp, Macaca fascicularis
cattttattgggaggcataattttcaggttacagagcagtgataactacctgccagtgtctcttaggagtgaggtacctggagttgagggaccccaacctgtggcaatgacagcggacgagttggttttctttgtgaacggcagaaaggtggtggagaaaaatgcagatccagagacaacccttttggcctacctgagaagaaggttggggctgagtggaaccaagctcggctgtggagagggaggctgtggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccccggcatcgtcatgagtatgtacacactgctccggaatcagcctgagcccaccatggaggagattgagaatgccttccaaggaaatctgtgccgctgcacaggctacagacccatcctccagggcttccggacctttgccaggggtggtggatgctgtgaaggagatgggaacaatccaaactgctgcatgagccagaagaaagaccactcggtcagtctctcaccatctttattcaagccagaggagttcacgcccctggatcccacccaggagcccatttttcccccagagttgctgaggttgaaagacactcctcggaagcagctgcgatttgaaggggagcgtgtgacgtggatacaggcctcaaccctcaaggagctgctggacctcaaggctcagtaccctgatgccaagctggtggtggggaacacggagattggcattgagatgaagttcaagaatatgctgtttcctatgatcgtctgcccagcttggatccctgagctgaattcagtagaacatggacccgagggtatctccttcggagctgcttgccccctgagcattgtggaaaagaccctggttgatgccattgctaagcttcctgcccaaaagacggaggtgttcagaggggtcctggagcagctgcgctggtttgctgggaagcaggtcaagtctgtggcgtccattggagggaacatcatcactgccagccccatctccgacctcaaccctgtgttcatggccagtggggccaagctgacacttgtgtccagaggcaccaggagaactgttccaatggaccacacattcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtagaggagctggccctttgctatggcggaatggccgacagaaccatctcggccctcaagaccactcagaggcagctttccaagctctggaccgaggagctgctgcaggacgtgtgtgcggccctggcggaggagctgcatctgcctcccgacgcccctggtggcatggtggacttccggcgcaccctcaccctcagcttcttcttcaagttctacctgacagtccttcggaagctgggccaagagaacccagaggactgtggtaaactggaccccacgttcgccagtgcaactttactctttcagaaagacccgccagccaatgtccatctcttccaagaggtgcccaagggccagtctgaggaggacatggtgggccggcccctgccccacctggcagcgaacatgcaggcctctggtgaggccgtgtactgtgacgacatccctcgctatgagaatgagctgtctctccggctggtcaccagcacccgggcccacgccaagatcaagtccatagacatatcagaagccaagaaggtgccagggtttgtttgtttcatttccgctgatgatattcctgggagtaacataactggaatttgtaacgatgagacagtctttgcaaaggataaggttacttgtgttgggcatatcattggtgctgtggttgctgacaccccagaacacacacagagagctgcccaaggggtgaaaatcacctatgaagaactaccagccattatcacaattgaggatgctataaataacaactccttttatggacctgagctgaagatcgagaaaggggacctcaagaaggggttttccgaagcagataatgttgtgtcaggggagttatacatcggtggccaagagcacttctacctggagactcactgcaccattgctgttccaaaaggcgaggaaggagagatggagctctttgtgtctacacagaacaccatgaagacacagagctttgttgcaaaaatgttgggagttccagaaaaccggattgtggttcgagtgaagagaatcggaggaggctttggagggaaggagacccggagcactctggtgtccacggcggtggccctggccgcatataagactggccgccctgtgcgctgcatgctggaccgtgatgaggacatgctgataactggtggcagacatcccttcctggccagatacaaggttggcttcatgaagactgggaaggttgtggctctggaggtggatcacttcagcaacggggggaacacccaggatctctctcagagtattatggaacgagctctattccacatggacaactgctataaaattcccaacatccggggcactgggcggctgtgcaaaaccaaccttccctccaacacggccttccggggctttgggggtccccaggggatgctcattgccgagtattggatgagtgaagttgcggtgacctgtgggatgcctgcagaggaggtgcggatgaaaaacctgtacaaagaaggggacctgacacacttcaaccagaagcttgagagtttcaccttgcccaggtgctgggaagaatgcctagcaagctctcagtatcatgctcggaagagtgaggttgacaagttcaacaaggagaattgttggaaaaagagaggattgtacataattcccaccaagtttggaataagcttcacacttccttttctgaatcaggcaggagccctgcttcatgtgtacacagatggctctgtgctgctgacccatggagggaccgagatgggccaaggccttcataccaaaatggtccaggtggccagcagagctctgaaaatccccacctctaagatttatatcagtgagacaagcactaacactgtgcccaacacttctcccacggctgcctctgtcagcgctgacctcaatggacaagccgtctacgcggcttgtcagaccatcttgaaaaggctggaaccctacaagaagaagaatcccagtggctcctgggaagactgggtcacagctgcctacacggacacagtgagcttgtctgccactgggttttatagaacacccaatctgggctacagctttgagactaactcagggaaccctttccactacttcagctatggggtggcttgctctgaagtagaaattgactgcttaacaggagatcataagaacctccgcacagatattgtcatggatgttggctccagtctaaaccctgccattgatattggacaggtggaaggggcatttgtccagggccttggccttttcaccctagaggagctacactactcccccgaggggagcctgcacacccgcggccctagcacttacaagatcccggcatttggcagcatccccattgagttcagggtgtccctgctccgagactgccccaacaagaaggccatctatgcatcaaaggctgttggagagccacccctcttcctggctgcttctatcttctttgccatcaaagatgccatccgtgcagctcgagctcagcacacaggtaataacgtgaaggaactcttccggctagacagccctgccaccccggagaagatccgcaacgcctgcgtggacaggttcaccaccctgtgtgtcactggtgtaccagaaaactgcaaaccctggtctgtgagggtctgaagagagagtcctcagcagagtcttcctgtgctgcatttgggcttccatggagcaggaggaacataccacagaacatggatctattaaagtcacagaaggacagtgactaattctgtgacttttcatcctaattcatcaggatggcatttggaagacaagtgaatgcattgggagattttgattaaaatgtaatttataaacagaatgataagcaaattcaaaactgttaggcctaaatggtgaatatgcaattagggtcattttctgtctgttctaatcatgtatttggaatagggtcaggaagggtttgtgctattccccacttactggacagcctgtataacctcaagttctgatggtgtctgtccttcaaaagggactcccacaaacctctagaagcttaaaccaaagttactttaaattgtgtgccttcctctgaaagccttgccttcaaaccaatgaacagcaaagcataaccttgaatctatactcaaattttgcagtgaggcagtggggtaagattaaatcctctaaccatctttgaatcattggaaagaataaagaatgaaacaaattcaaggttaattgaatctaattttgttaagctgcataaagcaagattactctataacacaaaaatccaaccaactcaattattgagcacctacaatgttctagatttctttcccttcctctttgagtatttacaaaaaaagattatgtttaatctttacatttgaagccaaagtaatttccacctagaaatgatgctagcaggcctggcatggtggctcacgcctgtaatcccagcactttgggaggctgaggcaggagaattgcttgagcccagcagtttgagaccagcctgggcaacatagagagctcctgtcgtctggatagtgcatgcctgtagtctcaactactagaaaggctgaggtggagagatcatttgagttcaggaggttgagactgcagtgagctgtgactgcacccttgcactcctgcctgagctactgagcaagatcttgtctctgaagaaaaaaaaaagaaataaaaatgctgctgtcaaaatcaagctcaaccagaggtagaagagccaagaagcctgagttctcatcccagctctgtctcttctgtctctagctttgtgatcttggactgtcatttccccttcctgtgatccattttactgcagtaaaggttgtctcctgtcttctgctttaaaagtctataaatatatgacctgaaaactccagttacgtaagggatctgcagctatctaaggcttggttttcttactgtcatatgatacctgggcctgatgaactctgcttagatcccctcaagtttctgcggttggtaaagagaacaagggaagaacaagcatcccttttattgctctaagaggtgatttaatccctacatggtgctgagtggacagtgtgtcactgttgcatgccttcactctataaatccaaccttctgccagacagaatctgtggttctgtccatggagggaggataatggaaatgatatagttggactggtgcttgatgtcactaataaatgaaactgtcagcttgtt

SEQ ID NO: 16 - DNA, 5691 bp, Macaca fascicularis
aacaagctgacagtttcatttattagtgacatcaagcaccagtccaactatatcatttccattatcctccctccatggacagaaccacagattctgtctggcagaaggttggatttatagagtgaaggcatgcaacagtgacacactgtccactcagcaccatgtagggattaaatcacctcttagagcaataaaagggatgcttgttcttcccttgttctctttaccaaccgcagaaacttgaggggatctaagcagagttcatcaggcccaggtatcatatgacagtaagaaaaccaagccttagatagctgcagatcccttacgtaactggagttttcaggtcatatatttatagacttttaaagcagaagacaggagacaacctttactgcagtaaaatggatcacaggaaggggaaatgacagtccaagatcacaaagctagagacagaagagacagagctgggatgagaactcaggcttcttggctcttctacctctggttgagcttgattttgacagcagcatttttatttcttttttttttcttcagagacaagatcttgctcagtagctcaggcaggagtgcaagggtgcagtcacagctcactgcagtctcaacctcctgaactcaaatgatctctccacctcagcctttctagtagttgagactacaggcatgcactatccagacgacaggagctctctatgttgcccaggctggtctcaaactgctgggctcaagcaattctcctgcctcagcctcccaaagtgctgggattacaggcgtgagccaccatgccaggcctgctagcatcatttctaggtggaaattactttggcttcaaatgtaaagattaaacataatctttttttgtaaatactcaaagaggaagggaaagaaatctagaacattgtaggtgctcaataattgagttggttggatttttgtgttatagagtaatcttgctttatgcagcttaacaaaattagattcaattaaccttgaatttgtttcattctttattctttccaatgattcaaagatggttagaggatttaatcttaccccactgcctcactgcaaaatttgagtatagattcaaggttatgctttgctgttcattggtttgaaggcaaggctttcagaggaaggcacacaatttaaagtaactttggtttaagcttctagaggtttgtgggagtcccttttgaaggacagacaccatcagaacttgaggttatacaggctgtccagtaagtggggaatagcacaaacccttcctgaccctattccaaatacatgattagaacagacagaaaatgaccctaattgcatattcaccatttaggcctaacagttttgaatttgcttatcattctgtttataaattacattttaatcaaaatctcccaatgcattcacttgtcttccaaatgccatcctgatgaattaggatgaaaagtcacagaattagtcactgtccttctgtgactttaatagatccatgttctgtggtatgttcctcctgctccatggaagcccaaatgcagcacaggaagactctgctgaggactctctcttcagaccctcacagaccagggtttgcagttttctggtacaccagtgacacacagggtggtgaacctgtccacgcaggcgttgcggatcttctccggggtggcagggctgtctagccggaagagttccttcacgttattacctgtgtgctgagctcgagctgcacggatggcatctttgatggcaaagaagatagaagcagccaggaagaggggtggctctccaacagcctttgatgcatagatggccttcttgttggggcagtctcggagcagggacaccctgaactcaatggggatgctgccaaatgccgggatcttgtaagtgctagggccgcgggtgtgcaggctcccctcgggggagtagtgtagctcctctagggtgaaaaggccaaggccctggacaaatgccccttccacctgtccaatatcaatggcagggtttagactggagccaacatccatgacaatatctgtgcggaggttcttatgatctcctgttaagcagtcaatttctacttcagagcaagccaccccatagctgaagtagtggaaagggttccctgagttagtctcaaagctgtagcccagattgggtgttctataaaacccagtggcagacaagctcactgtgtccgtgtaggcagctgtgacccagtcttcccaggagccactgggattcttcttcttgtagggttccagccttttcaagatggtctgacaagccgcgtagacggcttgtccattgaggtcagcgctgacagaggcagccgtgggagaagtgttgggcacagtgttagtgcttgtctcactgatataaatcttagaggtggggattttcagagctctgctggccacctggaccattttggtatgaaggccttggcccatctcggtccctccatgggtcagcagcacagagccatctgtgtacacatgaagcagggctcctgcctgattcagaaaaggaagtgtgaagcttattccaaacttggtgggaattatgtacaatcctctctttttccaacaattctccttgttgaacttgtcaacctcactcttccgagcatgatactgagagcttgctaggcattcttcccagcacctgggcaaggtgaaactctcaagcttctggttgaagtgtgtcaggtccccttctttgtacaggtttttcatccgcacctcctctgcaggcatcccacaggtcaccgcaacttcactcatccaatactcggcaatgagcatcccctggggacccccaaagccccggaaggccgtgttggagggaaggttggttttgcacagccgcccagtgccccggatgttgggaattttatagcagttgtccatgtggaatagagctcgttccataatactctgagagagatcctgggtgttccccccgttgctgaagtgatccacctccagagccacaaccttcccagtcttcatgaagccaaccttgtatctggccaggaagggatgtctgccaccagttatcagcatgtcctcatcacggtccagcatgcagcgcacagggcggccagtcttatatgcggccagggccaccgccgtggacaccagagtgctccgggtctccttccctccaaagcctcctccgattctcttcactcgaaccacaatccggttttctggaactcccaacatttttgcaacaaagctctgtgtcttcatggtgttctgtgtagacacaaagagctccatctctccttcctcgccttttggaacagcaatggtgcagtgagtctccaggtagaagtgctcttggccaccgatgtataactcccctgacacaacattatctgcttcggaaaaccccttcttgaggtcccctttctcgatcttcagctcaggtccataaaaggagttgttatttatagcatcctcaattgtgataatggctggtagttcttcataggtgattttcaccccttgggcagctctctgtgtgtgttctggggtgtcagcaaccacagcaccaatgatatgcccaacacaagtaaccttatcctttgcaaagactgtctcatcgttacaaattccagttatgttactcccaggaatatcatcagcggaaatgaaacaaacaaaccctggcaccttcttggcttctgatatgtctatggacttgatcttggcgtgggcccgggtgctggtgaccagccggagagacagctcattctcatagcgagggatgtcgtcacagtacacggcctcaccagaggcctgcatgttcgctgccaggtggggcaggggccggcccaccatgtcctcctcagactggcccttgggcacctcttggaagagatggacattggctggcgggtctttctgaaagagtaaagttgcactggcgaacgtggggtccagtttaccacagtcctctgggttctcttggcccagcttccgaaggactgtcaggtagaacttgaagaagaagctgagggtgagggtgcgccggaagtccaccatgccaccaggggcgtcgggaggcagatgcagctcctccgccagggccgcacacacgtcctgcagcagctcctcggtccagagcttggaaagctgcctctgagtggtcttgagggccgagatggttctgtcggccattccgccatagcaaagggccagctcctctacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaatgtgtggtccattggaacagttctcctggtgcctctggacacaagtgtcagcttggccccactggccatgaacacagggttgaggtcggagatggggctggcagtgatgatgttccctccaatggacgccacagacttgacctgcttcccagcaaaccagcgcagctgctccaggacccctctgaacacctccgtcttttgggcaggaagcttagcaatggcatcaaccagggtcttttccacaatgctcagggggcaagcagctccgaaggagataccctcgggtccatgttctactgaattcagctcagggatccaagctgggcagacgatcataggaaacagcatattcttgaacttcatctcaatgccaatctccgtgttccccaccaccagcttggcatcagggtactgagccttgaggtccagcagctccttgagggttgaggcctgtatccacgtcacacgctccccttcaaatcgcagctgcttccgaggagtgtctttcaacctcagcaactctgggggaaaaatgggctcctgggtgggatccaggggcgtgaactcctctggcttgaataaagatggtgagagactgaccgagtggtctttcttctggctcatgcagcagtttggattgttcccatctccttcacagcatccaccacccctggcaaaggtccggaagccctggaggatgggtctgtagcctgtgcagcggcacagatttccttggaaggcattctcaatctcctccatggtgggctcaggctgattccggagcagtgtgtacatactcatgacgatgccgggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccacagcctccctctccacagccgagcttggttccactcagccccaaccttcttctcaggtaggccaaaagggttgtctctggatctgcatttttctccaccacctttctgccgttcacaaagaaaaccaactcgtccgctgtcattgccacaggttggggtccctcaactccaggtacctcactcctaagagacactggcaggtagttatcactgctctgtaacctgaaaattatgcctcccaataaaatg

SEQ ID NO: 17 - protein, 16 aa, Unknown
  source: /note="Description of Unknown: RGFG peptide sequence"
AAVALLPAVLLALLAP

SEQ ID NO: 18 - protein, 11 aa, Unknown
  source: /note="Description of Unknown: RGFG analogue sequence"
AALLPVLLAAP

SEQ ID NO: 19 - protein, 13 aa, Human immunodeficiency virus
GRKKRRQRRRPPQ

SEQ ID NO: 20 - protein, 16 aa, Drosophila sp.
RQIKIWFQNRRMKWKK

SEQ ID NO: 21 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 22 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 23 - RNA, 21 nt, Artificial Sequence
  source: /note="Description of Artificial Sequence: Synthetic oligonucleotide"
uaccugccagugucucuuagu

SEQ ID NO: 24 - RNA, 21 nt, Artificial Sequence
  source: /note="Description of Artificial Sequence: Synthetic oligonucleotide"
accugccagugucucuuaggu

SEQ ID NO: 25 - RNA, 21 nt, Artificial Sequence
  source: /note="Description of Artificial Sequence: Synthetic oligonucleotide"
ccugccagugucucuuaggau

SEQ ID NO: 26 - RNA, 21 nt, Artificial Sequence
  source: /note="Description of Artificial Sequence: Synthetic oligonucleotide"
ugccagugucucuuaggaguu

SEQ ID NO: 27 - RNA, 21 nt, Artificial Sequence
  source: /note="Description of Artificial Sequence: Synthetic oligonucleotide"
gccagugucucuuaggagugu

SEQ ID NO: 28 - RNA, 21 nt, Artificial Sequence
  source: /note="Description of Artificial Sequence: Synthetic oligonucleotide"
ccagugucucuuaggagugau

SEQ ID NO: 29 - RNA, 21 nt, Artificial Sequence
  source: /note="Description of Artificial Sequence: Synthetic oligonucleotide"
cagugucucuuaggagugagu

SEQ ID NO: 30 - RNA, 21 nt, Artificial Sequence
  source: /note="Description of Artificial Sequence: Synthetic oligonucleotide"
agugucucuuaggagugaggu

SEQ ID NO: 31 - RNA, 21 nt, Artificial Sequence
  source: /note="Description of Artificial Sequence: Synthetic oligonucleotide"
uggagaaaaaugcagauccau

SEQ ID NO: 32 - RNA, 21 nt, Artificial Sequence
  source: /note="Description of Artificial Sequence: Synthetic oligonucleotide"
ccagagacaacccuuuuggcu

SEQ ID NO: 33 - RNA, 21 nt, Artificial Sequence
  source: /note="Description of Artificial Sequence: Synthetic oligonucleotide"
agagacaacccuuuuggccuu

SEQ ID NO: 34 - RNA, 21 nt, Artificial Sequence
  source: /note="Description of Artificial Sequence: Synthetic oligonucleotide"
gcacagugaugcucuccaagu

SEQ ID NO: 35 - RNA, 21 nt, Artificial Sequence
  source: /note="Description of Artificial Sequence: Synthetic oligonucleotide"
cacagugaugcucuccaaguu

SEQ ID NO: 36 - RNA, 21 nt, Artificial Sequence
  source: /note="Description of Artificial Sequence: Synthetic oligonucleotide"
gaugcucuccaaguaugaucu

SEQ ID NO: 37 - RNA, 21 nt, Artificial Sequence
  source: /note="Description of Artificial Sequence: Synthetic oligonucleotide"
augcucuccaaguaugaucgu

SEQ ID NO: 38 - RNA, 21 nt, Artificial Sequence
  source: /note="Description of Artificial Sequence: Synthetic oligonucleotide"
ugcucuccaaguaugaucguu

SEQ ID NO: 39 - RNA, 21 nt, Artificial Sequence
  source: /note="Description of Artificial Sequence: Synthetic oligonucleotide"
gcucuccaaguaugaucgucu

SEQ ID NO: 40 - RNA, 21 nt, Artificial Sequence
  source: /note="Description of Artificial Sequence: Synthetic oligonucleotide"
cucuccaaguaugaucgucuu

SEQ ID NO: 41 - RNA, 21 nt, Artificial Sequence
  source: /note="Description of Artificial Sequence: Synthetic oligonucleotide"
gaucgucugcagaacaagauu

SEQ ID NO: 42 - RNA, 21 nt, Artificial Sequence
  source: /note="Description of Artificial Sequence: Synthetic oligonucleotide"
cgucugcagaacaagaucguu

SEQ ID NO: 43 - RNA, 21 nt, Artificial Sequence
  source: /note="Description of Artificial Sequence: Synthetic oligonucleotide"
gucugcagaacaagaucgucu

SEQ ID NO: 44 - RNA, 21 nt, Artificial Sequence
  source: /note="Description of Artificial Sequence: Synthetic oligonucleotide"
ucugcagaacaagaucguccu

SEQ ID NO: 45 - RNA, 21 nt, Artificial Sequence
  source: /note="Description of Artificial Sequence: Synthetic oligonucleotide"
gcagaacaagaucguccacuu

SEQ ID NO: 46 - RNA, 21 nt, Artificial Sequence
  source: /note="Description of Artificial Sequence: Synthetic oligonucleotide"
cagaacaagaucguccacuuu

SEQ ID NO: 47 - RNA, 21 nt, Artificial Sequence
  source: /note="Description of Artificial Sequence: Synthetic oligonucleotide"
gaacaagaucguccacuuuuu

SEQ ID NO: 48 - RNA, 21 nt, Artificial Sequence
  source: /note="Description of Artificial Sequence: Synthetic oligonucleotide"
aacaagaucguccacuuuucu

SEQ ID NO: 49 - RNA, 21 nt, Artificial Sequence
  source: /note="Description of Artificial Sequence: Synthetic oligonucleotide"
acaagaucguccacuuuucuu

SEQ ID NO: 50 - RNA, 21 nt, Artificial Sequence
  source: /note="Description of Artificial Sequence: Synthetic oligonucleotide"
caagaucguccacuuuucugu

SEQ ID NO: 51 - RNA, 21 nt, Artificial Sequence
  source: /note="Description of Artificial Sequence: Synthetic oligonucleotide"
aagaucguccacuuuucugcu

SEQ ID NO: 52 - RNA, 21 nt, Artificial Sequence
  source: /note="Description of Artificial Sequence: Synthetic oligonucleotide"
cguccacuuuucugccaaugu

SEQ ID NO: 53 - RNA, 21 nt, Artificial Sequence
  source: /note="Description of Artificial Sequence: Synthetic oligonucleotide"
guccacuuuucugccaaugcu

SEQ ID NO: 54 - RNA, 21 nt, Artificial Sequence
  source: /note="Description of Artificial Sequence: Synthetic oligonucleotide"
ugcuccuugcaccauguugcu

SEQ ID NO: 55 - RNA, 21 nt, Artificial Sequence
  source: /note="Description of Artificial Sequence: Synthetic oligonucleotide"
uccuugcaccauguugcaguu

SEQ ID NO: 56 - RNA, 21 nt, Artificial Sequence
  source: /note="Description of Artificial Sequence: Synthetic oligonucleotide"
uugcaccauguugcagugacu

SEQ ID NO: 57 - RNA, 21 nt, Artificial Sequence
  source: /note="Description of Artificial Sequence: Synthetic oligonucleotide"
caccauguugcagugacaacu

SEQ ID NO: 58 - RNA, 21 nt, Artificial Sequence
  source: /note="Description of Artificial Sequence: Synthetic oligonucleotide"
accauguugcagugacaacuu

SEQ ID NO: 59 - RNA, 21 nt, Artificial Sequence
  source: /note="Description of Artificial Sequence: Synthetic oligonucleotide"
aggagagaauugccaaaagcu

SEQ ID NO: 60 - RNA, 21 nt, Artificial Sequence
  source: /note="Description of Artificial Sequence: Synthetic oligonucleotide"
ggagagaauugccaaaagccu

SEQ ID NO: 61 - RNA, 21 nt, Artificial Sequence
  source: /note="Description of Artificial Sequence: Synthetic oligonucleotide"
uggcaucgucaugaguauguu

SEQ ID NO: 62 - RNA, 21 nt, Artificial Sequence
  source: /note="Description of Artificial Sequence: Synthetic oligonucleotide"
ggcaucgucaugaguauguau

SEQ ID NO: 63 - RNA, 21 nt, Artificial Sequence
  source: /note="Description of Artificial Sequence: Synthetic oligonucleotide"
gcaucgucaugaguauguacu

SEQ ID NO: 64 - RNA, 21 nt, Artificial Sequence
  source: /note="Description of Artificial Sequence: Synthetic oligonucleotide"
caucgucaugaguauguacau

SEQ ID NO: 65 - RNA, 21 nt, Artificial Sequence
  source: /note="Description of Artificial Sequence: Synthetic oligonucleotide"
aucgucaugaguauguacacu

SEQ ID NO: 66 - RNA, 21 nt, Artificial Sequence
  source: /note="Description of Artificial Sequence: Synthetic oligonucleotide"
cgucaugaguauguacacacu

SEQ ID NO: 67 - RNA, 21 nt, Artificial Sequence
  source: /note="Description of Artificial Sequence: Synthetic oligonucleotide"
gucaugaguauguacacacuu

SEQ ID NO: 68 - RNA, 21 nt, Artificial Sequence
  source: /note="Description of Artificial Sequence: Synthetic oligonucleotide"
ucaugaguauguacacacugu

SEQ ID NO: 69 - RNA, 21 nt, Artificial Sequence
  source: /note="Description of Artificial Sequence: Synthetic oligonucleotide"
aaugccuuccaaggaaaucuu

SEQ ID NO: 70 - RNA, 21 nt, Artificial Sequence
  source: /note="Description of Artificial Sequence: Synthetic oligonucleotide"
augccuuccaaggaaaucugu

SEQ ID NO: 71 - RNA, 21 nt, Artificial Sequence
  source: /note="Description of Artificial Sequence: Synthetic oligonucleotide"
ugccuuccaaggaaaucuguu

SEQ ID NO: 72 - RNA, 21 nt, Artificial Sequence
  source: /note="Description of Artificial Sequence: Synthetic oligonucleotide"
gccuuccaaggaaaucugugu

SEQ ID NO: 73 - RNA, 21 nt, Artificial Sequence
  source: /note="Description of Artificial Sequence: Synthetic oligonucleotide"
ccuuccaaggaaaucugugcu

SEQ ID NO: 74 - RNA, 21 nt, Artificial Sequence
  source: /note="Description of Artificial Sequence: Synthetic oligonucleotide"
gagaugaaguucaagaauauu

SEQ ID NO: 75 - RNA, 21 nt, Artificial Sequence
  source: /note="Description of Artificial Sequence: Synthetic oligonucleotide"
gaugaaguucaagaauaugcu

SEQ ID NO: 76 - RNA, 21 nt, Artificial Sequence
  source: /note="Description of Artificial Sequence: Synthetic oligonucleotide"
aaguucaagaauaugcuguuu

SEQ ID NO: 77 - RNA, 21 nt, Artificial Sequence
  source: /note="Description of Artificial Sequence: Synthetic oligonucleotide"
aguucaagaauaugcuguuuu

SEQ ID NO: 78 - RNA, 21 nt, Artificial Sequence
  source: /note="Description of Artificial Sequence: Synthetic oligonucleotide"
guucaagaauaugcuguuucu

SEQ ID NO: 79 - RNA, 21 nt, Artificial Sequence
  source: /note="Description of Artificial Sequence: Synthetic oligonucleotide"
uucaagaauaugcuguuuccu

SEQ ID NO: 80 - RNA, 21 nt, Artificial Sequence
  source: /note="Description of Artificial Sequence: Synthetic oligonucleotide"
aagaauaugcuguuuccuauu

SEQ ID NO: 81 - RNA, 21 nt, Artificial Sequence
  source: /note="Description of Artificial Sequence: Synthetic oligonucleotide"
gggaguauuucucagcauucu

SEQ ID NO: 82 - RNA, 21 nt, Artificial Sequence
  source: /note="Description of Artificial Sequence: Synthetic oligonucleotide"
ggaguauuucucagcauucau

SEQ ID NO: 83 - RNA, 21 nt, Artificial Sequence
  source: /note="Description of Artificial Sequence: Synthetic oligonucleotide"
gaguauuucucagcauucaau

SEQ ID NO: 84 - RNA, 21 nt, Artificial Sequence
  source: /note="Description of Artificial Sequence: Synthetic oligonucleotide"
aguauuucucagcauucaagu

SEQ ID NO: 85 - RNA, 21 nt, Artificial Sequence
  source: /note="Description of Artificial Sequence: Synthetic oligonucleotide"
guauuucucagcauucaagcu

SEQ ID NO: 86 - RNA, 21 nt, Artificial Sequence
  source: /note="Description of Artificial Sequence: Synthetic oligonucleotide"
guggcaugagaguuuuauucu

SEQ ID NO: 87 - RNA, 21 nt, Artificial Sequence
  source: /note="Description of Artificial Sequence: Synthetic oligonucleotide"
ggcaugagaguuuuauucaau

SEQ ID NO: 88 - RNA, 21 nt, Artificial Sequence
  source: /note="Description of Artificial Sequence: Synthetic oligonucleotide"
caugagaguuuuauucaagcu

SEQ ID NO: 89 - RNA, 21 nt, Artificial Sequence
  source: /note="Description of Artificial Sequence: Synthetic oligonucleotide"
ccucacccucagcuucuucuu

SEQ ID NO: 90 - RNA, 21 nt, Artificial Sequence
  source: /note="Description of Artificial Sequence: Synthetic oligonucleotide"
ucacccucagcuucuucuucu

SEQ ID NO: 91 - RNA, 21 nt, Artificial Sequence
  source: /note="Description of Artificial Sequence: Synthetic oligonucleotide"
ucuucaaguucuaccugacau

SEQ ID NO: 92 - RNA, 21 nt, Artificial Sequence
  source: /note="Description of Artificial Sequence: Synthetic oligonucleotide"
uuucgccagugcaacuuuacu

SEQ ID NO: 93 - RNA, 21 nt, Artificial Sequence
  source: /note="Description of Artificial Sequence: Synthetic oligonucleotide"
uucgccagugcaacuuuacuu

SEQ ID NO: 94 - RNA, 21 nt, Artificial Sequence
  source: /note="Description of Artificial Sequence: Synthetic oligonucleotide"
uuccaggguuuguuuguuucu

SEQ ID NO: 95 - RNA, 21 nt, Artificial Sequence
  source: /note="Description of Artificial Sequence: Synthetic oligonucleotide"
caggguuuguuuguuucauuu

SEQ ID NO: 96 - RNA, 21 nt, Artificial Sequence
  source: /note="Description of Artificial Sequence: Synthetic oligonucleotide"
ggguuuguuuguuucauuucu

SEQ ID NO: 97 - RNA, 21 nt, Artificial Sequence
  source: /note="Description of Artificial Sequence: Synthetic oligonucleotide"
gguuuguuuguuucauuuccu

SEQ ID NO: 98 - RNA, 21 nt, Artificial Sequence
  source: /note="Description of Artificial Sequence: Synthetic oligonucleotide"
uuguuuguuucauuuccgcuu

SEQ ID NO: 99 - RNA, 21 nt, Artificial Sequence
  source: /note="Description of Artificial Sequence: Synthetic oligonucleotide"
uuccugggaguaacauaacuu

SEQ ID NO: 100 - RNA, 21 nt, Artificial Sequence
  source: /note="Description of Artificial Sequence: Synthetic oligonucleotide"
gggaguaacauaacuggaauu

SEQ ID NO: 101 - RNA, 21 nt, Artificial Sequence
  source: /note="Description of Artificial Sequence: Synthetic oligonucleotide"
uaacauaacuggaauuuguau

SEQ ID NO: 102 - RNA, 21 nt, Artificial Sequence
  source: /note="Description of Artificial Sequence: Synthetic oligonucleotide"
aacauaacuggaauuuguaau

SEQ ID NO: 103 - RNA, 21 nt, Artificial Sequence
  source: /note="Description of Artificial Sequence: Synthetic oligonucleotide"
cgaaggauaagguuacuuguu

SEQ ID NO: 104 - RNA, 21 nt, Artificial Sequence
  source: /note="Description of Artificial Sequence: Synthetic oligonucleotide"
gaaggauaagguuacuugugu

SEQ ID NO: 105 - RNA, 21 nt, Artificial Sequence
  source: /note="Description of Artificial Sequence: Synthetic oligonucleotide"
gggugaaaaucaccuaugaau

SEQ ID NO: 106 - RNA, 21 nt, Artificial Sequence
  source: /note="Description of Artificial Sequence: Synthetic oligonucleotide"
aaucaccuaugaagaacuacu

SEQ ID NO: 107 - RNA, 21 nt, Artificial Sequence
  source: /note="Description of Artificial Sequence: Synthetic oligonucleotide"
aucaccuaugaagaacuaccu

SEQ ID NO: 108 - RNA, 21 nt, Artificial Sequence
  source: /note="Description of Artificial Sequence: Synthetic oligonucleotide"
uaccagccauuaucacaauuu

SEQ ID NO: 109 - RNA, 21 nt, Artificial Sequence
  source: /note="Description of Artificial Sequence: Synthetic oligonucleotide"
gaacaacuccuuuuauggacu

SEQ ID NO: 110 - RNA, 21 nt, Artificial Sequence
  source: /note="Description of Artificial Sequence: Synthetic oligonucleotide"
ggccaagagcacuucuaccuu

SEQ ID NO: 111 - RNA, 21 nt, Artificial Sequence
  source: /note="Description of Artificial Sequence: Synthetic oligonucleotide"
gagcacuucuaccuggagacu

SEQ ID NO: 112 - RNA, 21 nt, Artificial Sequence
  source: /note="Description of Artificial Sequence: Synthetic oligonucleotide"
gcacuucuaccuggagacucu

SEQ ID NO: 113 - RNA, 21 nt, Artificial Sequence
  source: /note="Description of Artificial Sequence: Synthetic oligonucleotide"
cacuucuaccuggagacucau

SEQ ID NO: 114 - RNA, 21 nt, Artificial Sequence
  source: /note="Description of Artificial Sequence: Synthetic oligonucleotide"
ucacugcaccauugcuguucu

SEQ ID NO: 115 - RNA, 21 nt, Artificial Sequence
  source: /note="Description of Artificial Sequence: Synthetic oligonucleotide"
cacugcaccauugcuguuccu

SEQ ID NO: 116 - RNA, 21 nt, Artificial Sequence
  source: /note="Description of Artificial Sequence: Synthetic oligonucleotide"
ccauugcuguuccaaaaggcu

SEQ ID NO: 117 - RNA, 21 nt, Artificial Sequence
  source: /note="Description of Artificial Sequence: Synthetic oligonucleotide"
agcucuuugugucuacacagu

SEQ ID NO: 118 - RNA, 21 nt, Artificial Sequence
  source: /note="Description of Artificial Sequence: Synthetic oligonucleotide"
gcucuuugugucuacacagau

SEQ ID NO: 119 - RNA, 21 nt, Artificial Sequence
  source: /note="Description of Artificial Sequence: Synthetic oligonucleotide"
cucuuugugucuacacagaau

SEQ ID NO: 120 - RNA, 21 nt, Artificial Sequence
  source: /note="Description of Artificial Sequence: Synthetic oligonucleotide"
ucuuugugucuacacagaacu

SEQ ID NO: 121 - RNA, 21 nt, Artificial Sequence
  source: /note="Description of Artificial Sequence: Synthetic oligonucleotide"
cuuugugucuacacagaacau

SEQ ID NO: 122 - RNA, 21 nt, Artificial Sequence
  source: /note="Description of Artificial Sequence: Synthetic oligonucleotide"
uuugugucuacacagaacacu

SEQ ID NO: 123 - RNA, 21 nt, Artificial Sequence
  source: /note="Description of Artificial Sequence: Synthetic oligonucleotide"
acacagaacaccaugaagacu

SEQ ID NO: 124 - RNA, 21 nt, Artificial Sequence
  source: /note="Description of Artificial Sequence: Synthetic oligonucleotide"
gagcuuuguugcaaaaauguu

SEQ ID NO: 125 - RNA, 21 nt, Artificial Sequence
  source: /note="Description of Artificial Sequence: Synthetic oligonucleotide"
agcuuuguugcaaaaauguuu

SEQ ID NO: 126 - RNA, 21 nt, Artificial Sequence
  source: /note="Description of Artificial Sequence: Synthetic oligonucleotide"
aggaucucucucagaguauuu

SEQ ID NO: 127 - RNA, 21 nt, Artificial Sequence
  source: /note="Description of Artificial Sequence: Synthetic oligonucleotide"
ggaucucucucagaguauuau

SEQ ID NO: 128 - RNA, 21 nt, Artificial Sequence
  source: /note="Description of Artificial Sequence: Synthetic oligonucleotide"
gaucucucucagaguauuauu

SEQ ID NO: 129 - RNA, 21 nt, Artificial Sequence
  source: /note="Description of Artificial Sequence: Synthetic oligonucleotide"
aucucucucagaguauuaugu

SEQ ID NO: 130 - RNA, 21 nt, Artificial Sequence
  source: /note="Description of Artificial Sequence: Synthetic oligonucleotide"
ucucucucagaguauuauggu

SEQ ID NO: 131 - RNA, 21 nt, Artificial Sequence
  source: /note="Description of Artificial Sequence: Synthetic oligonucleotide"
cucucucagaguauuauggau

SEQ ID NO: 132 - RNA, 21 nt, Artificial Sequence
  source: /note="Description of Artificial Sequence: Synthetic oligonucleotide"
ucucucagaguauuauggaau

SEQ ID NO: 133 - RNA, 21 nt, Artificial Sequence
  source: /note="Description of Artificial Sequence: Synthetic oligonucleotide"
cucucagaguauuauggaacu

SEQ ID NO: 134 - RNA, 21 nt, Artificial Sequence
  source: /note="Description of Artificial Sequence: Synthetic oligonucleotide"
ucucagaguauuauggaacgu

SEQ ID NO: 135 - RNA, 21 nt, Artificial Sequence
  source: /note="Description of Artificial Sequence: Synthetic oligonucleotide"
ucagaguauuauggaacgagu

SEQ ID NO: 136 - RNA, 21 nt, Artificial Sequence
  source: /note="Description of Artificial Sequence: Synthetic oligonucleotide"
cagaguauuauggaacgagcu

SEQ ID NO: 137 - RNA, 21 nt, Artificial Sequence
  source: /note="Description of Artificial Sequence: Synthetic oligonucleotide"
gcugugcaaaaccaaccuucu

SEQ ID NO: 138 - RNA, 21 nt, Artificial Sequence
  source: /note="Description of Artificial Sequence: Synthetic oligonucleotide"
cugugcaaaaccaaccuuccu

SEQ ID NO: 139 - RNA, 21 nt, Artificial Sequence
  source: /note="Description of Artificial Sequence: Synthetic oligonucleotide"
ccugacacacuucaaccagau

SEQ ID NO: 140 - RNA, 21 nt, Artificial Sequence
  source: /note="Description of Artificial Sequence: Synthetic oligonucleotide"
ugacacacuucaaccagaagu

SEQ ID NO: 141 - RNA, 21 nt, Artificial Sequence
  source: /note="Description of Artificial Sequence: Synthetic oligonucleotide"
gacacacuucaaccagaagcu

SEQ ID NO: 142 - RNA, 21 nt, Artificial Sequence
  source: /note="Description of Artificial Sequence: Synthetic oligonucleotide"
acacuucaaccagaagcuugu

SEQ ID NO: 143 - RNA, 21 nt, Artificial Sequence
  source: /note="Description of Artificial Sequence: Synthetic oligonucleotide"
augccuagcaagcucucaguu

SEQ ID NO: 144 - RNA, 21 nt, Artificial Sequence
  source: /note="Description of Artificial Sequence: Synthetic oligonucleotide"
ccuagcaagcucucaguaucu

SEQ ID NO: 145 - RNA, 21 nt, Artificial Sequence
  source: /note="Description of Artificial Sequence: Synthetic oligonucleotide"
cuagcaagcucucaguaucau

SEQ ID NO: 146 - RNA, 21 nt, Artificial Sequence
  source: /note="Description of Artificial Sequence: Synthetic oligonucleotide"
uagcaagcucucaguaucauu

SEQ ID NO: 147 - RNA, 21 nt, Artificial Sequence
  source: /note="Description of Artificial Sequence: Synthetic oligonucleotide"
agcaagcucucaguaucaugu

SEQ ID NO: 148 - RNA, 21 nt, Artificial Sequence
  source: /note="Description of Artificial Sequence: Synthetic oligonucleotide"
caagcucucaguaucaugcuu

SEQ ID NO: 149 - RNA, 21 nt, Artificial Sequence
  source: /note="Description of Artificial Sequence: Synthetic oligonucleotide"
cucggaagagugagguugacu

SEQ ID NO: 150 - RNA, 21 nt, Artificial Sequence
  source: /note="Description of Artificial Sequence: Synthetic oligonucleotide"
aaggagaauuguuggaaaaau

SEQ ID NO: 151 - RNA, 21 nt, Artificial Sequence
  source: /note="Description of Artificial Sequence: Synthetic oligonucleotide"
caccaaguuuggaauaagcuu

SEQ ID NO: 152 - RNA, 21 nt, Artificial Sequence
  source: /note="Description of Artificial Sequence: Synthetic oligonucleotide"
accaaguuuggaauaagcuuu

SEQ ID NO: 153 - RNA, 21 nt, Artificial Sequence
  source: /note="Description of Artificial Sequence: Synthetic oligonucleotide"
aguuccuuuucugaaucaggu

SEQ ID NO: 154 - RNA, 21 nt, Artificial Sequence
  source: /note="Description of Artificial Sequence: Synthetic oligonucleotide"
guuccuuuucugaaucaggcu

SEQ ID NO: 155 - RNA, 21 nt, Artificial Sequence
  source: /note="Description of Artificial Sequence: Synthetic oligonucleotide"
uuccuuuucugaaucaggcau

SEQ ID NO: 156 - RNA, 21 nt, Artificial Sequence
  source: /note="Description of Artificial Sequence: Synthetic oligonucleotide"
uacuucauguguacacagauu

SEQ ID NO: 157 - RNA, 21 nt, Artificial Sequence
  source: /note="Description of Artificial Sequence: Synthetic oligonucleotide"
caaggccuucauaccaaaauu

SEQ ID NO: 158 - RNA, 21 nt, Artificial Sequence
  source: /note="Description of Artificial Sequence: Synthetic oligonucleotide"
aaggccuucauaccaaaaugu

SEQ ID NO: 159 - RNA, 21 nt, Artificial Sequence
  source: /note="Description of Artificial Sequence: Synthetic oligonucleotide"
gccuucauaccaaaauggucu

SEQ ID NO: 160 - RNA, 21 nt, Artificial Sequence
  source: /note="Description of Artificial Sequence: Synthetic oligonucleotide"
caccucuaagauuuauaucau

SEQ ID NO: 161 - RNA, 21 nt, Artificial Sequence
  source: /note="Description of Artificial Sequence: Synthetic oligonucleotide"
accucuaagauuuauaucagu

SEQ ID NO: 162 - RNA, 21 nt, Artificial Sequence
  source: /note="Description of Artificial Sequence: Synthetic oligonucleotide"
gcgagacaagcacuaacacuu

SEQ ID NO: 163 - RNA, 21 nt, Artificial Sequence
  source: /note="Description of Artificial Sequence: Synthetic oligonucleotide"
cgagacaagcacuaacacugu

SEQ ID NO: 164 - RNA, 21 nt, Artificial Sequence
  source: /note="Description of Artificial Sequence: Synthetic oligonucleotide"
gagacaagcacuaacacuguu

SEQ ID NO: 165 - RNA, 21 nt, Artificial Sequence
  source: /note="Description of Artificial Sequence: Synthetic oligonucleotide"
agacaagcacuaacacugugu

SEQ ID NO: 166 - RNA, 21 nt, Artificial Sequence
  source: /note="Description of Artificial Sequence: Synthetic oligonucleotide"
cggcuugucagaccaucuugu

SEQ ID NO: 167 - RNA, 21 nt, Artificial Sequence
  source: /note="Description of Artificial Sequence: Synthetic oligonucleotide"
ggcuugucagaccaucuugau

SEQ ID NO: 168 - RNA, 21 nt, Artificial Sequence
  source: /note="Description of Artificial Sequence: Synthetic oligonucleotide"
gcuugucagaccaucuugaau

SEQ ID NO: 169 - RNA, 21 nt, Artificial Sequence
  source: /note="Description of Artificial Sequence: Synthetic oligonucleotide"
cuugucagaccaucuugaaau

SEQ ID NO: 170 - RNA, 21 nt, Artificial Sequence
  source: /note="Description of Artificial Sequence: Synthetic oligonucleotide"
uugucagaccaucuugaaaau

SEQ ID NO: 171 - RNA, 21 nt, Artificial Sequence
  source: /note="Description of Artificial Sequence: Synthetic oligonucleotide"
ugucagaccaucuugaaaagu

SEQ ID NO: 172 - RNA, 21 nt, Artificial Sequence
  source: /note="Description of Artificial Sequence: Synthetic oligonucleotide"
gucagaccaucuugaaaaggu

SEQ ID NO: 173 - RNA, 21 nt, Artificial Sequence
  source: /note="Description of Artificial Sequence: Synthetic oligonucleotide"
ucagaccaucuugaaaaggcu

SEQ ID NO: 174 - RNA, 21 nt, Artificial Sequence
  source: /note="Description of Artificial Sequence: Synthetic oligonucleotide"
acccuacaagaagaagaaucu

SEQ ID NO: 175 - RNA, 21 nt, Artificial Sequence
  source: /note="Description of Artificial Sequence: Synthetic oligonucleotide"
cugccacuggguuuuauagau

SEQ ID NO: 176 - RNA, 21 nt, Artificial Sequence
  source: /note="Description of Artificial Sequence: Synthetic oligonucleotide"
ugccacuggguuuuauagaau

SEQ ID NO: 177 - RNA, 21 nt, Artificial Sequence
  source: /note="Description of Artificial Sequence: Synthetic oligonucleotide"
cacuggguuuuauagaacacu

SEQ ID NO: 178 - RNA, 21 nt, Artificial Sequence
  source: /note="Description of Artificial Sequence: Synthetic oligonucleotide"
acuggguuuuauagaacaccu

SEQ ID NO: 179 - RNA, 21 nt, Artificial Sequence
  source: /note="Description of Artificial Sequence: Synthetic oligonucleotide"
ggguuuuauagaacacccaau

SEQ ID NO: 180 - RNA, 21 nt, Artificial Sequence
  source: /note="Description of Artificial Sequence: Synthetic oligonucleotide"
gguuuuauagaacacccaauu

SEQ ID NO: 181 - RNA, 21 nt, Artificial Sequence
  source: /note="Description of Artificial Sequence: Synthetic oligonucleotide"
ugggcuacagcuuugagacuu

SEQ ID NO: 182 - RNA, 21 nt, Artificial Sequence
  source: /note="Description of Artificial Sequence: Synthetic oligonucleotide"
gggcuacagcuuugagacuau

SEQ ID NO: 183 - RNA, 21 nt, Artificial Sequence
  source: /note="Description of Artificial Sequence: Synthetic oligonucleotide"
gcuacagcuuugagacuaacu

SEQ ID NO: 184 - RNA, 21 nt, Artificial Sequence
  source: /note="Description of Artificial Sequence: Synthetic oligonucleotide"
cuacagcuuugagacuaacuu

SEQ ID NO: 185 - RNA, 21 nt, Artificial Sequence
  source: /note="Description of Artificial Sequence: Synthetic oligonucleotide"
uacagcuuugagacuaacucu

SEQ ID NO: 186 - RNA, 21 nt, Artificial Sequence
  source: /note="Description of Artificial Sequence: Synthetic oligonucleotide"
acagcuuugagacuaacucau

SEQ ID NO: 187 - RNA, 21 nt, Artificial Sequence
  source: /note="Description of Artificial Sequence: Synthetic oligonucleotide"
cagcuuugagacuaacucagu

SEQ ID NO: 188 - RNA, 21 nt, Artificial Sequence
  source: /note="Description of Artificial Sequence: Synthetic oligonucleotide"
agcuuugagacuaacucaggu

SEQ ID NO: 189 - RNA, 21 nt, Artificial Sequence
  source: /note="Description of Artificial Sequence: Synthetic oligonucleotide"
cuuccacuacuucagcuaugu

SEQ ID NO: 190 - RNA, 21 nt, Artificial Sequence
  source: /note="Description of Artificial Sequence: Synthetic oligonucleotide"
uuccacuacuucagcuauggu

SEQ ID NO: 191 - RNA, 21 nt, Artificial Sequence
  source: /note="Description of Artificial Sequence: Synthetic oligonucleotide"
guggcuugcucugaaguagau

SEQ ID NO: 192 - RNA, 21 nt, Artificial Sequence
  source: /note="Description of Artificial Sequence: Synthetic oligonucleotide"
uggcuugcucugaaguagaau

SEQ ID NO: 193 - RNA, 21 nt, Artificial Sequence
  source: /note="Description of Artificial Sequence: Synthetic oligonucleotide"
ggcuugcucugaaguagaaau

SEQ ID NO: 194 - RNA, 21 nt, Artificial Sequence
  source: /note="Description of Artificial Sequence: Synthetic oligonucleotide"
gcuugcucugaaguagaaauu

SEQ ID NO: 195 - RNA, 21 nt, Artificial Sequence
  source: /note="Description of Artificial Sequence: Synthetic oligonucleotide"
ccuaacaggagaucauaagau

SEQ ID NO: 196 - RNA, 21 nt, Artificial Sequence
  source: /note="Description of Artificial Sequence: Synthetic oligonucleotide"
cuaacaggagaucauaagaau

SEQ ID NO: 197 - RNA, 21 nt, Artificial Sequence
  source: /note="Description of Artificial Sequence: Synthetic oligonucleotide"
uaacaggagaucauaagaacu

SEQ ID NO: 198 - RNA, 21 nt, Artificial Sequence
  source: /note="Description of Artificial Sequence: Synthetic oligonucleotide"
aacaggagaucauaagaaccu

SEQ ID NO: 199 - RNA, 21 nt, Artificial Sequence
  source: /note="Description of Artificial Sequence: Synthetic oligonucleotide"
ccuccgcacagauauugucau

SEQ ID NO: 200 - RNA, 21 nt, Artificial Sequence
  source: /note="Description of Artificial Sequence: Synthetic oligonucleotide"
cuccgcacagauauugucauu

SEQ ID NO: 201 - RNA, 21 nt, Artificial Sequence
  source: /note="Description of Artificial Sequence: Synthetic oligonucleotide"
uuggcuccagucuaaacccuu

SEQ ID NO: 202 - RNA, 21 nt, Artificial Sequence
  source: /note="Description of Artificial Sequence: Synthetic oligonucleotide"
uuccuggcugcuucuaucuuu

SEQ ID NO: 203 - RNA, 21 nt, Artificial Sequence
  source: /note="Description of Artificial Sequence: Synthetic oligonucleotide"
uccuggcugcuucuaucuucu

SEQ ID NO: 204 - RNA, 21 nt, Artificial Sequence
  source: /note="Description of Artificial Sequence: Synthetic oligonucleotide"
ccuggcugcuucuaucuucuu

SEQ ID NO: 205 - RNA, 21 nt, Artificial Sequence
  source: /note="Description of Artificial Sequence: Synthetic oligonucleotide"
cuggcugcuucuaucuucuuu

SEQ ID NO: 206 - RNA, 21 nt, Artificial Sequence
  source: /note="Description of Artificial Sequence: Synthetic oligonucleotide"
uggcugcuucuaucuucuuuu

SEQ ID NO: 207 - RNA, 21 nt, Artificial Sequence
  source: /note="Description of Artificial Sequence: Synthetic oligonucleotide"
gcugcuucuaucuucuuugcu

SEQ ID NO: 208 - RNA, 21 nt, Artificial Sequence
  source: /note="Description of Artificial Sequence: Synthetic oligonucleotide"
cugcuucuaucuucuuugccu

SEQ ID NO: 209 - RNA, 21 nt, Artificial Sequence
  source: /note="Description of Artificial Sequence: Synthetic oligonucleotide"
ugcuucuaucuucuuugccau

SEQ ID NO: 210 - RNA, 21 nt, Artificial Sequence
  source: /note="Description of Artificial Sequence: Synthetic oligonucleotide"
gcuucuaucuucuuugccauu

SEQ ID NO: 211 - RNA, 21 nt, Artificial Sequence
  source: /note="Description of Artificial Sequence: Synthetic oligonucleotide"
cuucuaucuucuuugccaucu

SEQ ID NO: 212 - RNA, 21 nt, Artificial Sequence
  source: /note="Description of Artificial Sequence: Synthetic oligonucleotide"
uucuaucuucuuugccaucau

SEQ ID NO: 213 - RNA, 21 nt, Artificial Sequence
  source: /note="Description of Artificial Sequence: Synthetic oligonucleotide"
ucuaucuucuuugccaucaau

SEQ ID NO: 214 - RNA, 21 nt, Artificial Sequence
  source: /note="Description of Artificial Sequence: Synthetic oligonucleotide"
cuaucuucuuugccaucaaau

SEQ ID NO: 215 - RNA, 21 nt, Artificial Sequence
  source: /note="Description of Artificial Sequence: Synthetic oligonucleotide"
uaucuucuuugccaucaaagu

SEQ ID NO: 216 - RNA, 21 nt, Artificial Sequence
  source: /note="Description of Artificial Sequence: Synthetic oligonucleotide"
aucuucuuugccaucaaagau

SEQ ID NO: 217 - RNA, 21 nt, Artificial Sequence
  source: /note="Description of Artificial Sequence: Synthetic oligonucleotide"
cuucuuugccaucaaagaugu

SEQ ID NO: 218 - RNA, 21 nt, Artificial Sequence
  source: /note="Description of Artificial Sequence: Synthetic oligonucleotide"
gagcucagcacacagguaauu

SEQ ID NO: 219 - RNA, 21 nt, Artificial Sequence
  source: /note="Description of Artificial Sequence: Synthetic oligonucleotide"
cucagcacacagguaauaacu

SEQ ID NO: 220 - RNA, 21 nt, Artificial Sequence
  source: /note="Description of Artificial Sequence: Synthetic oligonucleotide"
ucagcacacagguaauaacgu

SEQ ID NO: 221 - RNA, 21 nt, Artificial Sequence
  source: /note="Description of Artificial Sequence: Synthetic oligonucleotide"
cagcacacagguaauaacguu

SEQ ID NO: 222 - RNA, 21 nt, Artificial Sequence
  source: /note="Description of Artificial Sequence: Synthetic oligonucleotide"
acagguaauaacgugaaggau

SEQ ID NO: 223 - RNA, 21 nt, Artificial Sequence
  source: /note="Description of Artificial Sequence: Synthetic oligonucleotide"
cagguaauaacgugaaggaau

SEQ ID NO: 224 - RNA, 21 nt, Artificial Sequence
  source: /note="Description of Artificial Sequence: Synthetic oligonucleotide"
agguaauaacgugaaggaacu

SEQ ID NO: 225 - RNA, 21 nt, Artificial Sequence
  source: /note="Description of Artificial Sequence: Synthetic oligonucleotide"
auaacgugaaggaacucuucu

SEQ ID NO: 226 - RNA, 21 nt, Artificial Sequence
  source: /note="Description of Artificial Sequence: Synthetic oligonucleotide"
uaacgugaaggaacucuuccu

SEQ ID NO: 227 - RNA, 21 nt, Artificial Sequence
  source: /note="Description of Artificial Sequence: Synthetic oligonucleotide"
cccagaaaacugcaaacccuu

SEQ ID NO: 228 - RNA, 21 nt, Artificial Sequence
  source: /note="Description of Artificial Sequence: Synthetic oligonucleotide"
cacagaacauggaucuauuau

SEQ ID NO: 229 - RNA, 21 nt, Artificial Sequence
  source: /note="Description of Artificial Sequence: Synthetic oligonucleotide"
acagaacauggaucuauuaau

SEQ ID NO: 230 - RNA, 21 nt, Artificial Sequence
  source: /note="Description of Artificial Sequence: Synthetic oligonucleotide"
cagaacauggaucuauuaaau

SEQ ID NO: 231 - RNA, 21 nt, Artificial Sequence
  source: /note="Description of Artificial Sequence: Synthetic oligonucleotide"
agaacauggaucuauuaaagu

SEQ ID NO: 232 - RNA, 21 nt, Artificial Sequence
  source: /note="Description of Artificial Sequence: Synthetic oligonucleotide"
gaacauggaucuauuaaaguu

SEQ ID NO: 233 - RNA, 21 nt, Artificial Sequence
  source: /note="Description of Artificial Sequence: Synthetic oligonucleotide"
aacauggaucuauuaaagucu

SEQ ID NO: 234 - RNA, 21 nt, Artificial Sequence
  source: /note="Description of Artificial Sequence: Synthetic oligonucleotide"
acauggaucuauuaaagucau

SEQ ID NO: 235 - RNA, 21 nt, Artificial Sequence
  source: /note="Description of Artificial Sequence: Synthetic oligonucleotide"
cauggaucuauuaaagucacu

SEQ ID NO: 236 - RNA, 21 nt, Artificial Sequence
  source: /note="Description of Artificial Sequence: Synthetic oligonucleotide"
auggaucuauuaaagucacau

SEQ ID NO: 237 - RNA, 21 nt, Artificial Sequence
  source: /note="Description of Artificial Sequence: Synthetic oligonucleotide"
uggaucuauuaaagucacagu

SEQ ID NO: 238 - RNA, 21 nt, Artificial Sequence
  source: /note="Description of Artificial Sequence: Synthetic oligonucleotide"
ggaucuauuaaagucacagau

SEQ ID NO: 239 - RNA, 21 nt, Artificial Sequence
  source: /note="Description of Artificial Sequence: Synthetic oligonucleotide"
gaucuauuaaagucacagaau

SEQ ID NO: 240 - RNA, 21 nt, Artificial Sequence
  source: /note="Description of Artificial Sequence: Synthetic oligonucleotide"
acaaugauaagcaaauucaau

SEQ ID NO: 241 - RNA, 21 nt, Artificial Sequence
  source: /note="Description of Artificial Sequence: Synthetic oligonucleotide"
caaugauaagcaaauucaaau

SEQ ID NO: 242 - RNA, 21 nt, Artificial Sequence
  source: /note="Description of Artificial Sequence: Synthetic oligonucleotide"
augauaagcaaauucaaaacu

SEQ ID NO: 243 - RNA, 21 nt, Artificial Sequence
  source: /note="Description of Artificial Sequence: Synthetic oligonucleotide"
augccuaaauggugaauaugu

SEQ ID NO: 244 - RNA, 21 nt, Artificial Sequence
  source: /note="Description of Artificial Sequence: Synthetic oligonucleotide"
ugccuaaauggugaauaugcu

SEQ ID NO: 245 - RNA, 21 nt, Artificial Sequence
  source: /note="Description of Artificial Sequence: Synthetic oligonucleotide"
gccuaaauggugaauaugcau

SEQ ID NO: 246 - RNA, 21 nt, Artificial Sequence
  source: /note="Description of Artificial Sequence: Synthetic oligonucleotide"
ccuaaauggugaauaugcaau

SEQ ID NO: 247 - RNA, 21 nt, Artificial Sequence
  source: /note="Description of Artificial Sequence: Synthetic oligonucleotide"
cuaaauggugaauaugcaauu

SEQ ID NO: 248 - RNA, 21 nt, Artificial Sequence
  source: /note="Description of Artificial Sequence: Synthetic oligonucleotide"
aauggugaauaugcaauuagu

SEQ ID NO: 249 - RNA, 21 nt, Artificial Sequence
  source: /note="Description of Artificial Sequence: Synthetic oligonucleotide"
cgggaaggguuugugcuauuu

SEQ ID NO: 250 - RNA, 21 nt, Artificial Sequence
  source: /note="Description of Artificial Sequence: Synthetic oligonucleotide"
gggaaggguuugugcuauucu

SEQ ID NO: 251 - RNA, 21 nt, Artificial Sequence
  source: /note="Description of Artificial Sequence: Synthetic oligonucleotide"
ggaaggguuugugcuauuccu

SEQ ID NO: 252 - RNA, 21 nt, Artificial Sequence
  source: /note="Description of Artificial Sequence: Synthetic oligonucleotide"
guauaaccucaaguucugauu

SEQ ID NO: 253 - RNA, 21 nt, Artificial Sequence
  source: /note="Description of Artificial Sequence: Synthetic oligonucleotide"
uauaaccucaaguucugaugu

SEQ ID NO: 254 - RNA, 21 nt, Artificial Sequence
  source: /note="Description of Artificial Sequence: Synthetic oligonucleotide"
ccucaaguucugauggugucu

SEQ ID NO: 255 - RNA, 21 nt, Artificial Sequence
  source: /note="Description of Artificial Sequence: Synthetic oligonucleotide"
caaguucugauggugucuguu

SEQ ID NO: 256 - RNA, 21 nt, Artificial Sequence
  source: /note="Description of Artificial Sequence: Synthetic oligonucleotide"
ccacaaaccucuagaagcuuu

SEQ ID NO: 257 - RNA, 21 nt, Artificial Sequence
  source: /note="Description of Artificial Sequence: Synthetic oligonucleotide"
acaaaccucuagaagcuuaau

SEQ ID NO: 258 - RNA, 21 nt, Artificial Sequence
  source: /note="Description of Artificial Sequence: Synthetic oligonucleotide"
aaaccucuagaagcuuaaacu

SEQ ID NO: 259 - RNA, 21 nt, Artificial Sequence
  source: /note="Description of Artificial Sequence: Synthetic oligonucleotide"
aaccucuagaagcuuaaaccu

SEQ ID NO: 260 - RNA, 21 nt, Artificial Sequence
  source: /note="Description of Artificial Sequence: Synthetic oligonucleotide"
uggccuucaaaccaaugaacu

SEQ ID NO: 261 - RNA, 21 nt, Artificial Sequence
  source: /note="Description of Artificial Sequence: Synthetic oligonucleotide"
ggccuucaaaccaaugaacau

SEQ ID NO: 262 - RNA, 21 nt, Artificial Sequence
  source: /note="Description of Artificial Sequence: Synthetic oligonucleotide"
gccuucaaaccaaugaacagu

SEQ ID NO: 263 - RNA, 21 nt, Artificial Sequence
  source: /note="Description of Artificial Sequence: Synthetic oligonucleotide"
ucaaaccaaugaacagcaaau

SEQ ID NO: 264 - RNA, 21 nt, Artificial Sequence
  source: /note="Description of Artificial Sequence: Synthetic oligonucleotide"
gaacagcaaagcauaaccuuu

SEQ ID NO: 265 - RNA, 21 nt, Artificial Sequence
  source: /note="Description of Artificial Sequence: Synthetic oligonucleotide"
aacagcaaagcauaaccuugu

SEQ ID NO: 266 - RNA, 21 nt, Artificial Sequence
  source: /note="Description of Artificial Sequence: Synthetic oligonucleotide"
agcaaagcauaaccuugaauu

SEQ ID NO: 267 - RNA, 21 nt, Artificial Sequence
  source: /note="Description of Artificial Sequence: Synthetic oligonucleotide"
gcaaagcauaaccuugaaucu

SEQ ID NO: 268 - RNA, 21 nt, Artificial Sequence
  source: /note="Description of Artificial Sequence: Synthetic oligonucleotide"
caaagcauaaccuugaaucuu

SEQ ID NO: 269 - RNA, 21 nt, Artificial Sequence
  source: /note="Description of Artificial Sequence: Synthetic oligonucleotide"
gcauaaccuugaaucuauacu

SEQ ID NO: 270 - RNA, 21 nt, Artificial Sequence
  source: /note="Description of Artificial Sequence: Synthetic oligonucleotide"
cauaaccuugaaucuauacuu

SEQ ID NO: 271 - RNA, 21 nt, Artificial Sequence
  source: /note="Description of Artificial Sequence: Synthetic oligonucleotide"
auaaccuugaaucuauacucu

SEQ ID NO: 272 - RNA, 21 nt, Artificial Sequence
  source: /note="Description of Artificial Sequence: Synthetic oligonucleotide"
uaaccuugaaucuauacucau

SEQ ID NO: 273 - RNA, 21 nt, Artificial Sequence
  source: /note="Description of Artificial Sequence: Synthetic oligonucleotide"
aaccuugaaucuauacucaau

SEQ ID NO: 274 - RNA, 21 nt, Artificial Sequence
  source: /note="Description of Artificial Sequence: Synthetic oligonucleotide"
accuugaaucuauacucaaau

SEQ ID NO: 275 - RNA, 21 nt, Artificial Sequence
  source: /note="Description of Artificial Sequence: Synthetic oligonucleotide"
ccuugaaucuauacucaaauu

SEQ ID NO: 276 - RNA, 21 nt, Artificial Sequence
  source: /note="Description of Artificial Sequence: Synthetic oligonucleotide"
aaucuauacucaaauuuugcu

SEQ ID NO: 277 - RNA, 21 nt, Artificial Sequence
  source: /note="Description of Artificial Sequence: Synthetic oligonucleotide"
aucuauacucaaauuuugcau

SEQ ID NO: 278 - RNA, 21 nt, Artificial Sequence
  source: /note="Description of Artificial Sequence: Synthetic oligonucleotide"
gguuaaauccucuaaccaucu

SEQ ID NO: 279 - RNA, 21 nt, Artificial Sequence
  source: /note="Description of Artificial Sequence: Synthetic oligonucleotide"
uaaauccucuaaccaucuuuu

SEQ ID NO: 280 - RNA, 21 nt, Artificial Sequence
  source: /note="Description of Artificial Sequence: Synthetic oligonucleotide"
aaauccucuaaccaucuuugu

SEQ ID NO: 281 - RNA, 21 nt, Artificial Sequence
  source: /note="Description of Artificial Sequence: Synthetic oligonucleotide"
aauccucuaaccaucuuugau

SEQ ID NO: 282 - RNA, 21 nt, Artificial Sequence
  source: /note="Description of Artificial Sequence: Synthetic oligonucleotide"
auccucuaaccaucuuugaau

SEQ ID NO: 283 - RNA, 21 nt, Artificial Sequence
  source: /note="Description of Artificial Sequence: Synthetic oligonucleotide"
uccucuaaccaucuuugaauu

SEQ ID NO: 284 - RNA, 21 nt, Artificial Sequence
  source: /note="Description of Artificial Sequence: Synthetic oligonucleotide"
ccucuaaccaucuuugaaucu

SEQ ID NO: 285 - RNA, 21 nt, Artificial Sequence
  source: /note="Description of Artificial Sequence: Synthetic oligonucleotide"
cucuaaccaucuuugaaucau

SEQ ID NO: 286 - RNA, 21 nt, Artificial Sequence
  source: /note="Description of Artificial Sequence: Synthetic oligonucleotide"
ucuaaccaucuuugaaucauu

SEQ ID NO: 287 - RNA, 21 nt, Artificial Sequence
  source: /note="Description of Artificial Sequence: Synthetic oligonucleotide"
cuaaccaucuuugaaucauuu

SEQ ID NO: 288 - RNA, 21 nt, Artificial Sequence
  source: /note="Description of Artificial Sequence: Synthetic oligonucleotide"
uaaccaucuuugaaucauugu

SEQ ID NO: 289 - RNA, 21 nt, Artificial Sequence
  source: /note="Description of Artificial Sequence: Synthetic oligonucleotide"
aaccaucuuugaaucauuggu

SEQ ID NO: 290 - RNA, 21 nt, Artificial Sequence
  source: /note="Description of Artificial Sequence: Synthetic oligonucleotide"
ccaucuuugaaucauuggaau

SEQ ID NO: 291 - RNA, 21 nt, Artificial Sequence
  source: /note="Description of Artificial Sequence: Synthetic oligonucleotide"
caucuuugaaucauuggaaau

SEQ ID NO: 292 - RNA, 21 nt, Artificial Sequence
  source: /note="Description of Artificial Sequence: Synthetic oligonucleotide"
aucuuugaaucauuggaaagu

SEQ ID NO: 293 - RNA, 21 nt, Artificial Sequence
  source: /note="Description of Artificial Sequence: Synthetic oligonucleotide"
cuuugaaucauuggaaagaau

SEQ ID NO: 294 - RNA, 21 nt, Artificial Sequence
  source: /note="Description of Artificial Sequence: Synthetic oligonucleotide"
gaaagaauaaagaaugaaacu

SEQ ID NO: 295 - RNA, 21 nt, Artificial Sequence
  source: /note="Description of Artificial Sequence: Synthetic oligonucleotide"
aaagaauaaagaaugaaacau

SEQ ID NO: 296 - RNA, 21 nt, Artificial Sequence
  source: /note="Description of Artificial Sequence: Synthetic oligonucleotide"
gaaugaaacaaauucaagguu

SEQ ID NO: 297 - RNA, 21 nt, Artificial Sequence
  source: /note="Description of Artificial Sequence: Synthetic oligonucleotide"
augaaacaaauucaagguuau

SEQ ID NO: 298 - RNA, 21 nt, Artificial Sequence
  source: /note="Description of Artificial Sequence: Synthetic oligonucleotide"
aacaaauucaagguuaauugu

SEQ ID NO: 299 - RNA, 21 nt, Artificial Sequence
  source: /note="Description of Artificial Sequence: Synthetic oligonucleotide"
ugaagcugcauaaagcaagau

SEQ ID NO: 300 - RNA, 21 nt, Artificial Sequence
  source: /note="Description of Artificial Sequence: Synthetic oligonucleotide"
aagcugcauaaagcaagauuu

SEQ ID NO: 301 - RNA, 21 nt, Artificial Sequence
  source: /note="Description of Artificial Sequence: Synthetic oligonucleotide"
agcugcauaaagcaagauuau

SEQ ID NO: 302 - RNA, 21 nt, Artificial Sequence
  source: /note="Description of Artificial Sequence: Synthetic oligonucleotide"
gcugcauaaagcaagauuacu

SEQ ID NO: 303 - RNA, 21 nt, Artificial Sequence
  source: /note="Description of Artificial Sequence: Synthetic oligonucleotide"
cugcauaaagcaagauuacuu

SEQ ID NO: 304 - RNA, 21 nt, Artificial Sequence
  source: /note="Description of Artificial Sequence: Synthetic oligonucleotide"
ugcauaaagcaagauuacucu

SEQ ID NO: 305 - RNA, 21 nt, Artificial Sequence
  source: /note="Description of Artificial Sequence: Synthetic oligonucleotide"
cauaaagcaagauuacucuau

SEQ ID NO: 306 - RNA, 21 nt, Artificial Sequence
  source: /note="Description of Artificial Sequence: Synthetic oligonucleotide"
uaaagcaagauuacucuauau

SEQ ID NO: 307 - RNA, 21 nt, Artificial Sequence
  source: /note="Description of Artificial Sequence: Synthetic oligonucleotide"
auacaaaaauccaaccaacuu

SEQ ID NO: 308 - RNA, 21 nt, Artificial Sequence
  source: /note="Description of Artificial Sequence: Synthetic oligonucleotide"
uacaaaaauccaaccaacucu

SEQ ID NO: 309 - RNA, 21 nt, Artificial Sequence
  source: /note="Description of Artificial Sequence: Synthetic oligonucleotide"
acaaaaauccaaccaacucau

SEQ ID NO: 310 - RNA, 21 nt, Artificial Sequence
  source: /note="Description of Artificial Sequence: Synthetic oligonucleotide"
caaaaauccaaccaacucaau

SEQ ID NO: 311 - RNA, 21 nt, Artificial Sequence
  source: /note="Description of Artificial Sequence: Synthetic oligonucleotide"
aaaaauccaaccaacucaauu

SEQ ID NO: 312 - RNA, 21 nt, Artificial Sequence
  source: /note="Description of Artificial Sequence: Synthetic oligonucleotide"
aaaauccaaccaacucaauuu

SEQ ID NO: 313 - RNA, 21 nt, Artificial Sequence
  source: /note="Description of Artificial Sequence: Synthetic oligonucleotide"
aaauccaaccaacucaauuau

SEQ ID NO: 314 - RNA, 21 nt, Artificial Sequence
  source: /note="Description of Artificial Sequence: Synthetic oligonucleotide"
aauccaaccaacucaauuauu

SEQ ID NO: 315 - RNA, 21 nt, Artificial Sequence
  source: /note="Description of Artificial Sequence: Synthetic oligonucleotide"
auccaaccaacucaauuauuu

SEQ ID NO: 316 - RNA, 21 nt, Artificial Sequence
  source: /note="Description of Artificial Sequence: Synthetic oligonucleotide"
uccaaccaacucaauuauugu

SEQ ID NO: 317 - RNA, 21 nt, Artificial Sequence
  source: /note="Description of Artificial Sequence: Synthetic oligonucleotide"
ccaaccaacucaauuauugau

SEQ ID NO: 318 - RNA, 21 nt, Artificial Sequence
  source: /note="Description of Artificial Sequence: Synthetic oligonucleotide"
caaccaacucaauuauugagu

SEQ ID NO: 319 - RNA, 21 nt, Artificial Sequence
  source: /note="Description of Artificial Sequence: Synthetic oligonucleotide"
aaccaacucaauuauugagcu

SEQ ID NO: 320 - RNA, 21 nt, Artificial Sequence
  source: /note="Description of Artificial Sequence: Synthetic oligonucleotide"
accaacucaauuauugagcau

SEQ ID NO: 321 - RNA, 21 nt, Artificial Sequence
  source: /note="Description of Artificial Sequence: Synthetic oligonucleotide"
ccaacucaauuauugagcacu

SEQ ID NO: 322 - RNA, 21 nt, Artificial Sequence
  source: /note="Description of Artificial Sequence: Synthetic oligonucleotide"
cguacaauguucuagauuucu

SEQ ID NO: 323 - RNA, 21 nt, Artificial Sequence
  source: /note="Description of Artificial Sequence: Synthetic oligonucleotide"
guacaauguucuagauuucuu

SEQ ID NO: 324 - RNA, 21 nt, Artificial Sequence
  source: /note="Description of Artificial Sequence: Synthetic oligonucleotide"
uacaauguucuagauuucuuu

SEQ ID NO: 325 - RNA, 21 nt, Artificial Sequence
  source: /note="Description of Artificial Sequence: Synthetic oligonucleotide"
acaauguucuagauuucuuuu

SEQ ID NO: 326 - RNA, 21 nt, Artificial Sequence
  source: /note="Description of Artificial Sequence: Synthetic oligonucleotide"
caauguucuagauuucuuucu

SEQ ID NO: 327 - RNA, 21 nt, Artificial Sequence
  source: /note="Description of Artificial Sequence: Synthetic oligonucleotide"
aauguucuagauuucuuuccu

SEQ ID NO: 328 - RNA, 21 nt, Artificial Sequence
  source: /note="Description of Artificial Sequence: Synthetic oligonucleotide"
guucuagauuucuuucccuuu

SEQ ID NO: 329 - RNA, 21 nt, Artificial Sequence
  source: /note="Description of Artificial Sequence: Synthetic oligonucleotide"
uucuagauuucuuucccuucu

SEQ ID NO: 330 - RNA, 21 nt, Artificial Sequence
  source: /note="Description of Artificial Sequence: Synthetic oligonucleotide"
ucuuuacauuugaagccaaau

SEQ ID NO: 331 - RNA, 21 nt, Artificial Sequence
  source: /note="Description of Artificial Sequence: Synthetic oligonucleotide"
cuuuacauuugaagccaaagu

SEQ ID NO: 332 - RNA, 21 nt, Artificial Sequence
  source: /note="Description of Artificial Sequence: Synthetic oligonucleotide"
uuuacauuugaagccaaaguu

SEQ ID NO: 333 - RNA, 21 nt, Artificial Sequence
  source: /note="Description of Artificial Sequence: Synthetic oligonucleotide"
acauuugaagccaaaguaauu

SEQ ID NO: 334 - RNA, 21 nt, Artificial Sequence
  source: /note="Description of Artificial Sequence: Synthetic oligonucleotide"
auuugaagccaaaguaauuuu

SEQ ID NO: 335 - RNA, 21 nt, Artificial Sequence
  source: /note="Description of Artificial Sequence: Synthetic oligonucleotide"
gaagccaaaguaauuuccacu

SEQ ID NO: 336 - RNA, 21 nt, Artificial Sequence
  source: /note="Description of Artificial Sequence: Synthetic oligonucleotide"
aagccaaaguaauuuccaccu

SEQ ID NO: 337 - RNA, 21 nt, Artificial Sequence
  source: /note="Description of Artificial Sequence: Synthetic oligonucleotide"
ccaaaguaauuuccaccuagu

SEQ ID NO: 338 - RNA, 21 nt, Artificial Sequence
  source: /note="Description of Artificial Sequence: Synthetic oligonucleotide"
caaaguaauuuccaccuagau

SEQ ID NO: 339 - RNA, 21 nt, Artificial Sequence
  source: /note="Description of Artificial Sequence: Synthetic oligonucleotide"
aaaguaauuuccaccuagaau

SEQ ID NO: 340 - RNA, 21 nt, Artificial Sequence
  source: /note="Description of Artificial Sequence: Synthetic oligonucleotide"
gcaagaucuugucucugaagu

SEQ ID NO: 341 - RNA, 21 nt, Artificial Sequence
  source: /note="Description of Artificial Sequence: Synthetic oligonucleotide"
agguagaagagccaagaagcu

SEQ ID NO: 342 - RNA, 21 nt, Artificial Sequence
  source: /note="Description of Artificial Sequence: Synthetic oligonucleotide"
cuagcucugucucuucugucu

SEQ ID NO: 343 - RNA, 21 nt, Artificial Sequence
  source: /note="Description of Artificial Sequence: Synthetic oligonucleotide"
uagcucugucucuucugucuu

SEQ ID NO: 344 - RNA, 21 nt, Artificial Sequence
  source: /note="Description of Artificial Sequence: Synthetic oligonucleotide"
agcucugucucuucugucucu

SEQ ID NO: 345 - RNA, 21 nt, Artificial Sequence
  source: /note="Description of Artificial Sequence: Synthetic oligonucleotide"
aucuuugugaucuuggacugu

SEQ ID NO: 346 - RNA, 21 nt, Artificial Sequence
  source: /note="Description of Artificial Sequence: Synthetic oligonucleotide"
cuuccugugauccauuuuacu

SEQ ID NO: 347 - RNA, 21 nt, Artificial Sequence
  source: /note="Description of Artificial Sequence: Synthetic oligonucleotide"
uuccugugauccauuuuacuu

SEQ ID NO: 348 - RNA, 21 nt, Artificial Sequence
  source: /note="Description of Artificial Sequence: Synthetic oligonucleotide"
uccugugauccauuuuacugu

SEQ ID NO: 349 - RNA, 21 nt, Artificial Sequence
  source: /note="Description of Artificial Sequence: Synthetic oligonucleotide"
ccugugauccauuuuacugcu

SEQ ID NO: 350 - RNA, 21 nt, Artificial Sequence
  source: /note="Description of Artificial Sequence: Synthetic oligonucleotide"
cugugauccauuuuacugcau

SEQ ID NO: 351 - RNA, 21 nt, Artificial Sequence
  source: /note="Description of Artificial Sequence: Synthetic oligonucleotide"
cuauaaauauaugaccugaau

SEQ ID NO: 352 - RNA, 21 nt, Artificial Sequence
  source: /note="Description of Artificial Sequence: Synthetic oligonucleotide"
ugaccugaaaacuccaguuau

SEQ ID NO: 353 - RNA, 21 nt, Artificial Sequence
  source: /note="Description of Artificial Sequence: Synthetic oligonucleotide"
gaccugaaaacuccaguuacu

SEQ ID NO: 354 - RNA, 21 nt, Artificial Sequence
  source: /note="Description of Artificial Sequence: Synthetic oligonucleotide"
aaggaucugcagcuaucuaau

SEQ ID NO: 355 - RNA, 21 nt, Artificial Sequence
  source: /note="Description of Artificial Sequence: Synthetic oligonucleotide"
aggaucugcagcuaucuaagu

SEQ ID NO: 356 - RNA, 21 nt, Artificial Sequence
  source: /note="Description of Artificial Sequence: Synthetic oligonucleotide"
gcuaucuaaggcuugguuuuu

SEQ ID NO: 357 - RNA, 21 nt, Artificial Sequence
  source: /note="Description of Artificial Sequence: Synthetic oligonucleotide"
cuaucuaaggcuugguuuucu

SEQ ID NO: 358 - RNA, 21 nt, Artificial Sequence
  source: /note="Description of Artificial Sequence: Synthetic oligonucleotide"
aucuaaggcuugguuuucuuu

SEQ ID NO: 359 - RNA, 21 nt, Artificial Sequence
  source: /note="Description of Artificial Sequence: Synthetic oligonucleotide"
ucuaaggcuugguuuucuuau

SEQ ID NO: 360 - RNA, 21 nt, Artificial Sequence
  source: /note="Description of Artificial Sequence: Synthetic oligonucleotide"
cuaaggcuugguuuucuuacu

SEQ ID NO: 361 - RNA, 21 nt, Artificial Sequence
  source: /note="Description of Artificial Sequence: Synthetic oligonucleotide"
uaaggcuugguuuucuuacuu

SEQ ID NO: 362 - RNA, 21 nt, Artificial Sequence
  source: /note="Description of Artificial Sequence: Synthetic oligonucleotide"
ggcuugguuuucuuacugucu

SEQ ID NO: 363 - RNA, 21 nt, Artificial Sequence
  source: /note="Description of Artificial Sequence: Synthetic oligonucleotide"
gcuugguuuucuuacugucau

SEQ ID NO: 364 - RNA, 21 nt, Artificial Sequence
  source: /note="Description of Artificial Sequence: Synthetic oligonucleotide"
cuugguuuucuuacugucauu

SEQ ID NO: 365 - RNA, 21 nt, Artificial Sequence
  source: /note="Description of Artificial Sequence: Synthetic oligonucleotide"
uugguuuucuuacugucauau

SEQ ID NO: 366 - RNA, 21 nt, Artificial Sequence
  source: /note="Description of Artificial Sequence: Synthetic oligonucleotide"
ugguuuucuuacugucauauu

SEQ ID NO: 367 - RNA, 21 nt, Artificial Sequence
  source: /note="Description of Artificial Sequence: Synthetic oligonucleotide"
gguuuucuuacugucauaugu

SEQ ID NO: 368 - RNA, 21 nt, Artificial Sequence
  source: /note="Description of Artificial Sequence: Synthetic oligonucleotide"
uuuucuuacugucauaugauu

SEQ ID NO: 369 - RNA, 21 nt, Artificial Sequence
  source: /note="Description of Artificial Sequence: Synthetic oligonucleotide"
uuucuuacugucauaugauau

SEQ ID NO: 370 - RNA, 21 nt, Artificial Sequence
  source: /note="Description of Artificial Sequence: Synthetic oligonucleotide"
ucuuacugucauaugauaccu

SEQ ID NO: 371 - RNA, 21 nt, Artificial Sequence
  source: /note="Description of Artificial Sequence: Synthetic oligonucleotide"
cuuacugucauaugauaccuu

SEQ ID NO: 372 - RNA, 21 nt, Artificial Sequence
  source: /note="Description of Artificial Sequence: Synthetic oligonucleotide"
ucugcgguugguaaagagaau

SEQ ID NO: 373 - RNA, 21 nt, Artificial Sequence
  source: /note="Description of Artificial Sequence: Synthetic oligonucleotide"
uggugauuuaaucccuacauu

SEQ ID NO: 374 - RNA, 21 nt, Artificial Sequence
  source: /note="Description of Artificial Sequence: Synthetic oligonucleotide"
ggugauuuaaucccuacaugu

SEQ ID NO: 375 - RNA, 21 nt, Artificial Sequence
  source: /note="Description of Artificial Sequence: Synthetic oligonucleotide"
uguauaaauccaaccuucugu

SEQ ID NO: 376 - RNA, 21 nt, Artificial Sequence
  source: /note="Description of Artificial Sequence: Synthetic oligonucleotide"
gugcuugaugucacuaauaau

SEQ ID NO: 377 - RNA, 21 nt, Artificial Sequence
  source: /note="Description of Artificial Sequence: Synthetic oligonucleotide"
ugcuugaugucacuaauaaau

SEQ ID NO: 378 - RNA, 21 nt, Artificial Sequence
  source: /note="Description of Artificial Sequence: Synthetic oligonucleotide"
gcuugaugucacuaauaaauu

SEQ ID NO: 379 - RNA, 21 nt, Artificial Sequence
  source: /note="Description of Artificial Sequence: Synthetic oligonucleotide"
augucacuaauaaaugaaacu

SEQ ID NO: 380 - RNA, 21 nt, Artificial Sequence
  source: /note="Description of Artificial Sequence: Synthetic oligonucleotide"
ugucacuaauaaaugaaacuu

SEQ ID NO: 381 - RNA, 21 nt, Artificial Sequence
  source: /note="Description of Artificial Sequence: Synthetic oligonucleotide"
uaauaaaugaaacugucagcu

SEQ ID NO: 382 - RNA, 23 nt, Artificial Sequence
  source: /note="Description of Artificial Sequence: Synthetic oligonucleotide"
acuaagagacacuggcagguagu

SEQ ID NO: 383 - RNA, 23 nt, Artificial Sequence
  source: /note="Description of Artificial Sequence: Synthetic oligonucleotide"
accuaagagacacuggcagguag

SEQ ID NO: 384 - RNA, 23 nt, Artificial Sequence
  source: /note="Description of Artificial Sequence: Synthetic oligonucleotide"
auccuaagagacacuggcaggua

SEQ ID NO: 385 - RNA, 23 nt, Artificial Sequence
  source: /note="Description of Artificial Sequence: Synthetic oligonucleotide"
aacuccuaagagacacuggcagg

SEQ ID NO: 386 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acactccuaagagacacuggcag

SEQ ID NO: 387 - RNA, 23 nt, Artificial Sequence
  source: /note="Description of Artificial Sequence: Synthetic oligonucleotide"
aucacuccuaagagacacuggca

SEQ ID NO: 388 - RNA, 23 nt, Artificial Sequence
  source: /note="Description of Artificial Sequence: Synthetic oligonucleotide"
acucacuccuaagagacacuggc

SEQ ID NO: 389 - RNA, 23 nt, Artificial Sequence
  source: /note="Description of Artificial Sequence: Synthetic oligonucleotide"
accucacuccuaagagacacugg

SEQ ID NO: 390 - RNA, 23 nt, Artificial Sequence
  source: /note="Description of Artificial Sequence: Synthetic oligonucleotide"
auggaucugcauuuuucuccacc

SEQ ID NO: 391 - RNA, 23 nt, Artificial Sequence
  source: /note="Description of Artificial Sequence: Synthetic oligonucleotide"
agccaaaaggguugucucuggau

SEQ ID NO: 392 - RNA, 23 nt, Artificial Sequence
  source: /note="Description of Artificial Sequence: Synthetic oligonucleotide"
aaggccaaaaggguugucucugg

SEQ ID NO: 393 - RNA, 23 nt, Artificial Sequence
  source: /note="Description of Artificial Sequence: Synthetic oligonucleotide"
acuuggagagcaucacugugcaa

SEQ ID NO: 394 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacutggagagcaucacugugca

SEQ ID NO: 395 - RNA, 23 nt, Artificial Sequence
  source: /note="Description of Artificial Sequence: Synthetic oligonucleotide"
agaucauacuuggagagcaucac

SEQ ID NO: 396 - RNA, 23 nt, Artificial Sequence
  source: /note="Description of Artificial Sequence: Synthetic oligonucleotide"
acgaucauacuuggagagcauca

SEQ ID NO: 397 - RNA, 23 nt, Artificial Sequence
  source: /note="Description of Artificial Sequence: Synthetic oligonucleotide"
aacgaucauacuuggagagcauc

SEQ ID NO: 398 - RNA, 23 nt, Artificial Sequence
  source: /note="Description of Artificial Sequence: Synthetic oligonucleotide"
agacgaucauacuuggagagcau

SEQ ID NO: 399 - RNA, 23 nt, Artificial Sequence
  source: /note="Description of Artificial Sequence: Synthetic oligonucleotide"
aagacgaucauacuuggagagca

SEQ ID NO: 400 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctuguucugcagacgaucau

SEQ ID NO: 401 - RNA, 23 nt, Artificial Sequence
  source: /note="Description of Artificial Sequence: Synthetic oligonucleotide"
aacgaucuuguucugcagacgau

SEQ ID NO: 402 - RNA, 23 nt, Artificial Sequence
  source: /note="Description of Artificial Sequence: Synthetic oligonucleotide"
agacgaucuuguucugcagacga

SEQ ID NO: 403 - RNA, 23 nt, Artificial Sequence
  source: /note="Description of Artificial Sequence: Synthetic oligonucleotide"
aggacgaucuuguucugcagacg

SEQ ID NO: 404 - RNA, 23 nt, Artificial Sequence
  source: /note="Description of Artificial Sequence: Synthetic oligonucleotide"
aaguggacgaucuuguucugcag

SEQ ID NO: 405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtggacgaucuuguucugca

SEQ ID NO: 406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaagtggacgaucuuguucug

SEQ ID NO: 407 - RNA, 23 nt, Artificial Sequence
  source: /note="Description of Artificial Sequence: Synthetic oligonucleotide"
agaaaaguggacgaucuuguucu

SEQ ID NO: 408 - RNA, 23 nt, Artificial Sequence
  source: /note="Description of Artificial Sequence: Synthetic oligonucleotide"
aagaaaaguggacgaucuuguuc

SEQ ID NO: 409 - RNA, 23 nt, Artificial Sequence
  source: /note="Description of Artificial Sequence: Synthetic oligonucleotide"
acagaaaaguggacgaucuuguu

SEQ ID NO: 410 - RNA, 23 nt, Artificial Sequence
  source: /note="Description of Artificial Sequence: Synthetic oligonucleotide"
agcagaaaaguggacgaucuugu

SEQ ID NO: 411 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acautggcagaaaaguggacgau

SEQ ID NO: 412 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatuggcagaaaaguggacga

SEQ ID NO: 413 - RNA, 23 nt, Artificial Sequence
  source: /note="Description of Artificial Sequence: Synthetic oligonucleotide"
agcaacauggugcaaggagcaga

SEQ ID NO: 414 - RNA, 23 nt, Artificial Sequence
  source: /note="Description of Artificial Sequence: Synthetic oligonucleotide"
aacugcaacauggugcaaggagc

SEQ ID NO: 415 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucactgcaacauggugcaagg

SEQ ID NO: 416 - RNA, 23 nt, Artificial Sequence
  source: /note="Description of Artificial Sequence: Synthetic oligonucleotide"
aguugucacugcaacauggugca

SEQ ID NO: 417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutgtcacugcaacauggugc

SEQ ID NO: 418 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcututggcaauucucuccugc

SEQ ID NO: 419 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggctutuggcaauucucuccug

SEQ ID NO: 420 - RNA, 23 nt, Artificial Sequence
  source: /note="Description of Artificial Sequence: Synthetic oligonucleotide"
aacauacucaugacgaugccagg

SEQ ID NO: 421 - RNA, 23 nt, Artificial Sequence
  source: /note="Description of Artificial Sequence: Synthetic oligonucleotide"
auacauacucaugacgaugccag

SEQ ID NO: 422 - RNA, 23 nt, Artificial Sequence
  source: /note="Description of Artificial Sequence: Synthetic oligonucleotide"
aguacauacucaugacgaugcca

SEQ ID NO: 423 - RNA, 23 nt, Artificial Sequence
  source: /note="Description of Artificial Sequence: Synthetic oligonucleotide"
auguacauacucaugacgaugcc

SEQ ID NO: 424 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtacauacucaugacgaugc

SEQ ID NO: 425 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtgtacauacucaugacgau

SEQ ID NO: 426 - RNA, 23 nt, Artificial Sequence
  source: /note="Description of Artificial Sequence: Synthetic oligonucleotide"
aaguguguacauacucaugacga

SEQ ID NO: 427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgtguacauacucaugacg

SEQ ID NO: 428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatutccuuggaaggcauucu

SEQ ID NO: 429 - RNA, 23 nt, Artificial Sequence
  source: /note="Description of Artificial Sequence: Synthetic oligonucleotide"
acagauuuccuuggaaggcauuc

SEQ ID NO: 430 - RNA, 23 nt, Artificial Sequence
  source: /note="Description of Artificial Sequence: Synthetic oligonucleotide"
aacagauuuccuuggaaggcauu

SEQ ID NO: 431 - RNA, 23 nt, Artificial Sequence
  source: /note="Description of Artificial Sequence: Synthetic oligonucleotide"
acacagauuuccuuggaaggcau

SEQ ID NO: 432 - RNA, 23 nt, Artificial Sequence
  source: /note="Description of Artificial Sequence: Synthetic oligonucleotide"
agcacagauuuccuuggaaggca

SEQ ID NO: 433 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatucuugaacuucaucucaa

SEQ ID NO: 434 - RNA, 23 nt, Artificial Sequence
  source: /note="Description of Artificial Sequence: Synthetic oligonucleotide"
agcauauucuugaacuucaucuc

SEQ ID NO: 435 - RNA, 23 nt, Artificial Sequence
  source: /note="Description of Artificial Sequence: Synthetic oligonucleotide"
aaacagcauauucuugaacuuca

SEQ ID NO: 436 - RNA, 23 nt, Artificial Sequence
  source: /note="Description of Artificial Sequence: Synthetic oligonucleotide"
aaaacagcauauucuugaacuuc

SEQ ID NO: 437 - RNA, 23 nt, Artificial Sequence
  source: /note="Description of Artificial Sequence: Synthetic oligonucleotide"
agaaacagcauauucuugaacuu

SEQ ID NO: 438 - RNA, 23 nt, Artificial Sequence
  source: /note="Description of Artificial Sequence: Synthetic oligonucleotide"
aggaaacagcauauucuugaacu

SEQ ID NO: 439 - RNA, 23 nt, Artificial Sequence
  source: /note="Description of Artificial Sequence: Synthetic oligonucleotide"
aauaggaaacagcauauucuuga

SEQ ID NO: 440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatgcugagaaauacuccccc

SEQ ID NO: 441 - RNA, 23 nt, Artificial Sequence
  source: /note="Description of Artificial Sequence: Synthetic oligonucleotide"
augaaugcugagaaauacucccc

SEQ ID NO: 442 - RNA, 23 nt, Artificial Sequence
  source: /note="Description of Artificial Sequence: Synthetic oligonucleotide"
auugaaugcugagaaauacuccc

SEQ ID NO: 443 - RNA, 23 nt, Artificial Sequence
  source: /note="Description of Artificial Sequence: Synthetic oligonucleotide"
acuugaaugcugagaaauacucc

SEQ ID NO: 444 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutgaaugcugagaaauacuc

SEQ ID NO: 445 - RNA, 23 nt, Artificial Sequence
  source: /note="Description of Artificial Sequence: Synthetic oligonucleotide"
agaauaaaacucucaugccacug

SEQ ID NO: 446 - RNA, 23 nt, Artificial Sequence
  source: /note="Description of Artificial Sequence: Synthetic oligonucleotide"
auugaauaaaacucucaugccac

SEQ ID NO: 447 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutgaauaaaacucucaugcc

SEQ ID NO: 448 - RNA, 23 nt, Artificial Sequence
  source: /note="Description of Artificial Sequence: Synthetic oligonucleotide"
aagaagaagcugagggugagggu

SEQ ID NO: 449 - RNA, 23 nt, Artificial Sequence
  source: /note="Description of Artificial Sequence: Synthetic oligonucleotide"
agaagaagaagcugagggugagg

SEQ ID NO: 450 - RNA, 23 nt, Artificial Sequence
  source: /note="Description of Artificial Sequence: Synthetic oligonucleotide"
augucagguagaacuugaagaag

SEQ ID NO: 451 - RNA, 23 nt, Artificial Sequence
  source: /note="Description of Artificial Sequence: Synthetic oligonucleotide"
aguaaaguugcacuggcgaaagu

SEQ ID NO: 452 - RNA, 23 nt, Artificial Sequence
  source: /note="Description of Artificial Sequence: Synthetic oligonucleotide"
aaguaaaguugcacuggcgaaag

SEQ ID NO: 453 - RNA, 23 nt, Artificial Sequence
  source: /note="Description of Artificial Sequence: Synthetic oligonucleotide"
agaaacaaacaaacccuggaacc

SEQ ID NO: 454 - RNA, 23 nt, Artificial Sequence
  source: /note="Description of Artificial Sequence: Synthetic oligonucleotide"
aaaugaaacaaacaaacccugga

SEQ ID NO: 455 - RNA, 23 nt, Artificial Sequence
  source: /note="Description of Artificial Sequence: Synthetic oligonucleotide"
agaaaugaaacaaacaaacccug

SEQ ID NO: 456 - RNA, 23 nt, Artificial Sequence
  source: /note="Description of Artificial Sequence: Synthetic oligonucleotide"
aggaaaugaaacaaacaaacccu

SEQ ID NO: 457 - RNA, 23 nt, Artificial Sequence
  source: /note="Description of Artificial Sequence: Synthetic oligonucleotide"
aagcggaaaugaaacaaacaaac

SEQ ID NO: 458 - RNA, 23 nt, Artificial Sequence
  source: /note="Description of Artificial Sequence: Synthetic oligonucleotide"
aaguuauguuacucccaggaaca

SEQ ID NO: 459 - RNA, 23 nt, Artificial Sequence
  source: /note="Description of Artificial Sequence: Synthetic oligonucleotide"
aauuccaguuauguuacucccag

SEQ ID NO: 460 - RNA, 23 nt, Artificial Sequence
  source: /note="Description of Artificial Sequence: Synthetic oligonucleotide"
auacaaauuccaguuauguuacu

SEQ ID NO: 461 - RNA, 23 nt, Artificial Sequence
  source: /note="Description of Artificial Sequence: Synthetic oligonucleotide"
auuacaaauuccaguuauguuac

SEQ ID NO: 462 - RNA, 23 nt, Artificial Sequence
  source: /note="Description of Artificial Sequence: Synthetic oligonucleotide"
aacaaguaaccuuauccuucgca

SEQ ID NO: 463 - RNA, 23 nt, Artificial Sequence
  source: /note="Description of Artificial Sequence: Synthetic oligonucleotide"
acacaaguaaccuuauccuucgc

SEQ ID NO: 464 - RNA, 23 nt, Artificial Sequence
  source: /note="Description of Artificial Sequence: Synthetic oligonucleotide"
auucauaggugauuuucaccccu

SEQ ID NO: 465 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguagutcuucauaggugauuuu

SEQ ID NO: 466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguagtucuucauaggugauuu

SEQ ID NO: 467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgtgauaauggcugguagu

SEQ ID NO: 468 - RNA, 23 nt, Artificial Sequence
  source: /note="Description of Artificial Sequence: Synthetic oligonucleotide"
aguccauaaaaggaguuguucuu

SEQ ID NO: 469 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtagaagugcucuuggccac

SEQ ID NO: 470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctccagguagaagugcucuu

SEQ ID NO: 471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtctccagguagaagugcuc

SEQ ID NO: 472 - RNA, 23 nt, Artificial Sequence
  source: /note="Description of Artificial Sequence: Synthetic oligonucleotide"
augagucuccagguagaagugcu

SEQ ID NO: 473 - RNA, 23 nt, Artificial Sequence
  source: /note="Description of Artificial Sequence: Synthetic oligonucleotide"
agaacagcaauggugcagugagu

SEQ ID NO: 474 - RNA, 23 nt, Artificial Sequence
  source: /note="Description of Artificial Sequence: Synthetic oligonucleotide"
aggaacagcaauggugcagugag

SEQ ID NO: 475 - RNA, 23 nt, Artificial Sequence
  source: /note="Description of Artificial Sequence: Synthetic oligonucleotide"
agccuuuuggaacagcaauggug

SEQ ID NO: 476 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgtagacacaaagagcucc

SEQ ID NO: 477 - RNA, 23 nt, Artificial Sequence
  source: /note="Description of Artificial Sequence: Synthetic oligonucleotide"
aucuguguagacacaaagagcuc

SEQ ID NO: 478 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgtguagacacaaagagcu

SEQ ID NO: 479 - RNA, 23 nt, Artificial Sequence
  source: /note="Description of Artificial Sequence: Synthetic oligonucleotide"
aguucuguguagacacaaagagc

SEQ ID NO: 480 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutctguguagacacaaagag

SEQ ID NO: 481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtucuguguagacacaaaga

SEQ ID NO: 482 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctucaugguguucuguguag

SEQ ID NO: 483 - RNA, 23 nt, Artificial Sequence
  source: /note="Description of Artificial Sequence: Synthetic oligonucleotide"
aacauuuuugcaacaaagcucug

SEQ ID NO: 484 - RNA, 23 nt, Artificial Sequence
  source: /note="Description of Artificial Sequence: Synthetic oligonucleotide"
aaacauuuuugcaacaaagcucu

SEQ ID NO: 485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauactcugagagagauccugg

SEQ ID NO: 486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatacucugagagagauccug

SEQ ID NO: 487 - RNA, 23 nt, Artificial Sequence
  source: /note="Description of Artificial Sequence: Synthetic oligonucleotide"
aauaauacucugagagagauccu

SEQ ID NO: 488 - RNA, 23 nt, Artificial Sequence
  source: /note="Description of Artificial Sequence: Synthetic oligonucleotide"
acauaauacucugagagagaucc

SEQ ID NO: 489 - RNA, 23 nt, Artificial Sequence
  source: /note="Description of Artificial Sequence: Synthetic oligonucleotide"
accauaauacucugagagagauc

SEQ ID NO: 490 - RNA, 23 nt, Artificial Sequence
  source: /note="Description of Artificial Sequence: Synthetic oligonucleotide"
auccauaauacucugagagagau

SEQ ID NO: 491 - RNA, 23 nt, Artificial Sequence
  source: /note="Description of Artificial Sequence: Synthetic oligonucleotide"
auuccauaauacucugagagaga

SEQ ID NO: 492 - RNA, 23 nt, Artificial Sequence
  source: /note="Description of Artificial Sequence: Synthetic oligonucleotide"
aguuccauaauacucugagagag

SEQ ID NO: 493 - RNA, 23 nt, Artificial Sequence
  source: /note="Description of Artificial Sequence: Synthetic oligonucleotide"
acguuccauaauacucugagaga

SEQ ID NO: 494 - RNA, 23 nt, Artificial Sequence
  source: /note="Description of Artificial Sequence: Synthetic oligonucleotide"
acucguuccauaauacucugaga

SEQ ID NO: 495 - RNA, 23 nt, Artificial Sequence
  source: /note="Description of Artificial Sequence: Synthetic oligonucleotide"
agcucguuccauaauacucugag

SEQ ID NO: 496 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaggtugguuuugcacagccg

SEQ ID NO: 497 - RNA, 23 nt, Artificial Sequence
  source: /note="Description of Artificial Sequence: Synthetic oligonucleotide"
aggaagguugguuuugcacagcc

SEQ ID NO: 498 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuggtugaagugugucagguc

SEQ ID NO: 499 - RNA, 23 nt, Artificial Sequence
  source: /note="Description of Artificial Sequence: Synthetic oligonucleotide"
acuucugguugaagugugucagg

SEQ ID NO: 500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutctgguugaagugugucag

SEQ ID NO: 501 - RNA, 23 nt, Artificial Sequence
  source: /note="Description of Artificial Sequence: Synthetic oligonucleotide"
acaagcuucugguugaagugugu

SEQ ID NO: 502 - RNA, 23 nt, Artificial Sequence
  source: /note="Description of Artificial Sequence: Synthetic oligonucleotide"
aacugagagcuugcuaggcauuc

SEQ ID NO: 503 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauactgagagcuugcuaggca

SEQ ID NO: 504 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatacugagagcuugcuaggc

SEQ ID NO: 505 - RNA, 23 nt, Artificial Sequence
  source: /note="Description of Artificial Sequence: Synthetic oligonucleotide"
aaugauacugagagcuugcuagg

SEQ ID NO: 506 - RNA, 23 nt, Artificial Sequence
  source: /note="Description of Artificial Sequence: Synthetic oligonucleotide"
acaugauacugagagcuugcuag

SEQ ID NO: 507 - RNA, 23 nt, Artificial Sequence
  source: /note="Description of Artificial Sequence: Synthetic oligonucleotide"
aagcaugauacugagagcuugcu

SEQ ID NO: 508 - RNA, 23 nt, Artificial Sequence
  source: /note="Description of Artificial Sequence: Synthetic oligonucleotide"
agucaaccucacucuuccgagca

SEQ ID NO: 509 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutuccaacaauucuccuugu

SEQ ID NO: 510 - RNA, 23 nt, Artificial Sequence
  source: /note="Description of Artificial Sequence: Synthetic oligonucleotide"
aagcuuauuccaaacuugguggg

SEQ ID NO: 511 - RNA, 23 nt, Artificial Sequence
  source: /note="Description of Artificial Sequence: Synthetic oligonucleotide"
aaagcuuauuccaaacuuggugg

SEQ ID NO: 512 - RNA, 23 nt, Artificial Sequence
  source: /note="Description of Artificial Sequence: Synthetic oligonucleotide"
accugauucagaaaaggaacugu

SEQ ID NO: 513 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctgauucagaaaaggaacug

SEQ ID NO: 514 - RNA, 23 nt, Artificial Sequence
  source: /note="Description of Artificial Sequence: Synthetic oligonucleotide"
augccugauucagaaaaggaacu

SEQ ID NO: 515 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctgtguacacaugaaguagg

SEQ ID NO: 516 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutugguaugaaggccuuggc

SEQ ID NO: 517 - RNA, 23 nt, Artificial Sequence
  source: /note="Description of Artificial Sequence: Synthetic oligonucleotide"
acauuuugguaugaaggccuugg

SEQ ID NO: 518 - RNA, 23 nt, Artificial Sequence
  source: /note="Description of Artificial Sequence: Synthetic oligonucleotide"
agaccauuuugguaugaaggccu

SEQ ID NO: 519 - RNA, 23 nt, Artificial Sequence
  source: /note="Description of Artificial Sequence: Synthetic oligonucleotide"
augauauaaaucuuagagguggg

SEQ ID NO: 520 - RNA, 23 nt, Artificial Sequence
  source: /note="Description of Artificial Sequence: Synthetic oligonucleotide"
acugauauaaaucuuagaggugg

SEQ ID NO: 521 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagugutagugcuugucucgcug

SEQ ID NO: 522 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgtuagugcuugucucgcu

SEQ ID NO: 523 - RNA, 23 nt, Artificial Sequence
  source: /note="Description of Artificial Sequence: Synthetic oligonucleotide"
aacaguguuagugcuugucucgc

SEQ ID NO: 524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acacagtguuagugcuugucucg

SEQ ID NO: 525 - RNA, 23 nt, Artificial Sequence
  source: /note="Description of Artificial Sequence: Synthetic oligonucleotide"
acaagauggucugacaagccgca

SEQ ID NO: 526 - RNA, 23 nt, Artificial Sequence
  source: /note="Description of Artificial Sequence: Synthetic oligonucleotide"
aucaagauggucugacaagccgc

SEQ ID NO: 527 - RNA, 23 nt, Artificial Sequence
  source: /note="Description of Artificial Sequence: Synthetic oligonucleotide"
auucaagauggucugacaagccg

SEQ ID NO: 528 - RNA, 23 nt, Artificial Sequence
  source: /note="Description of Artificial Sequence: Synthetic oligonucleotide"
auuucaagauggucugacaagcc

SEQ ID NO: 529 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcaagauggucugacaagc

SEQ ID NO: 530 - RNA, 23 nt, Artificial Sequence
  source: /note="Description of Artificial Sequence: Synthetic oligonucleotide"
acuuuucaagauggucugacaag

SEQ ID NO: 531 - RNA, 23 nt, Artificial Sequence
  source: /note="Description of Artificial Sequence: Synthetic oligonucleotide"
accuuuucaagauggucugacaa

SEQ ID NO: 532 - RNA, 23 nt, Artificial Sequence
  source: /note="Description of Artificial Sequence: Synthetic oligonucleotide"
agccuuuucaagauggucugaca

SEQ ID NO: 533 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautctucuucuuguaggguuc

SEQ ID NO: 534 - RNA, 23 nt, Artificial Sequence
  source: /note="Description of Artificial Sequence: Synthetic oligonucleotide"
aucuauaaaacccaguggcagac

SEQ ID NO: 535 - RNA, 23 nt, Artificial Sequence
  source: /note="Description of Artificial Sequence: Synthetic oligonucleotide"
auucuauaaaacccaguggcaga

SEQ ID NO: 536 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtucuauaaaacccaguggc

SEQ ID NO: 537 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggugutcuauaaaacccagugg

SEQ ID NO: 538 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugggtguucuauaaaacccag

SEQ ID NO: 539 - RNA, 23 nt, Artificial Sequence
  source: /note="Description of Artificial Sequence: Synthetic oligonucleotide"
aauuggguguucuauaaaaccca

SEQ ID NO: 540 - RNA, 23 nt, Artificial Sequence
  source: /note="Description of Artificial Sequence: Synthetic oligonucleotide"
aagucucaaagcuguagcccaga

SEQ ID NO: 541 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagtctcaaagcuguagcccag

SEQ ID NO: 542 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuagtcucaaagcuguagccc

SEQ ID NO: 543 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutagucucaaagcuguagcc

SEQ ID NO: 544 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtuagucucaaagcuguagc

SEQ ID NO: 545 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagutagucucaaagcuguag

SEQ ID NO: 546 - RNA, 23 nt, Artificial Sequence
  source: /note="Description of Artificial Sequence: Synthetic oligonucleotide"
acugaguuagucucaaagcugua

SEQ ID NO: 547 - RNA, 23 nt, Artificial Sequence
  source: /note="Description of Artificial Sequence: Synthetic oligonucleotide"
accugaguuagucucaaagcugu

SEQ ID NO: 548 - RNA, 23 nt, Artificial Sequence
  source: /note="Description of Artificial Sequence: Synthetic oligonucleotide"
acauagcugaaguaguggaaggg

SEQ ID NO: 549 - RNA, 23 nt, Artificial Sequence
  source: /note="Description of Artificial Sequence: Synthetic oligonucleotide"
accauagcugaaguaguggaagg

SEQ ID NO: 550 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuactucagagcaagccaccc

SEQ ID NO: 551 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctacuucagagcaagccacc

SEQ ID NO: 552 - RNA, 23 nt, Artificial Sequence
  source: /note="Description of Artificial Sequence: Synthetic oligonucleotide"
auuucuacuucagagcaagccac

SEQ ID NO: 553 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutctacuucagagcaagcca

SEQ ID NO: 554 - RNA, 23 nt, Artificial Sequence
  source: /note="Description of Artificial Sequence: Synthetic oligonucleotide"
aucuuaugaucuccuguuaggca

SEQ ID NO: 555 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctuaugaucuccuguuaggc

SEQ ID NO: 556 - RNA, 23 nt, Artificial Sequence
  source: /note="Description of Artificial Sequence: Synthetic oligonucleotide"
aguucuuaugaucuccuguuagg

SEQ ID NO: 557 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutctuaugaucuccuguuag

SEQ ID NO: 558 - RNA, 23 nt, Artificial Sequence
  source: /note="Description of Artificial Sequence: Synthetic oligonucleotide"
augacaauaucugugcggagguu

SEQ ID NO: 559 - RNA, 23 nt, Artificial Sequence
  source: /note="Description of Artificial Sequence: Synthetic oligonucleotide"
aaugacaauaucugugcggaggu

SEQ ID NO: 560 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagggutuagacuggagccaaca

SEQ ID NO: 561 - RNA, 23 nt, Artificial Sequence
  source: /note="Description of Artificial Sequence: Synthetic oligonucleotide"
aaagauagaagcagccaggaaga

SEQ ID NO: 562 - RNA, 23 nt, Artificial Sequence
  source: /note="Description of Artificial Sequence: Synthetic oligonucleotide"
agaagauagaagcagccaggaag

SEQ ID NO: 563 - RNA, 23 nt, Artificial Sequence
  source: /note="Description of Artificial Sequence: Synthetic oligonucleotide"
aagaagauagaagcagccaggaa

SEQ ID NO: 564 - RNA, 23 nt, Artificial Sequence
  source: /note="Description of Artificial Sequence: Synthetic oligonucleotide"
aaagaagauagaagcagccagga

SEQ ID NO: 565 - RNA, 23 nt, Artificial Sequence
  source: /note="Description of Artificial Sequence: Synthetic oligonucleotide"
aaaagaagauagaagcagccagg

SEQ ID NO: 566 - RNA, 23 nt, Artificial Sequence
  source: /note="Description of Artificial Sequence: Synthetic oligonucleotide"
agcaaagaagauagaagcagcca

SEQ ID NO: 567 - RNA, 23 nt, Artificial Sequence
  source: /note="Description of Artificial Sequence: Synthetic oligonucleotide"
aggcaaagaagauagaagcagcc

SEQ ID NO: 568 - RNA, 23 nt, Artificial Sequence
  source: /note="Description of Artificial Sequence: Synthetic oligonucleotide"
auggcaaagaagauagaagcagc

SEQ ID NO: 569 - RNA, 23 nt, Artificial Sequence
  source: /note="Description of Artificial Sequence: Synthetic oligonucleotide"
aauggcaaagaagauagaagcag

SEQ ID NO: 570 - RNA, 23 nt, Artificial Sequence
  source: /note="Description of Artificial Sequence: Synthetic oligonucleotide"
agauggcaaagaagauagaagca

SEQ ID NO: 571 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatggcaaagaagauagaagc

SEQ ID NO: 572 - RNA, 23 nt, Artificial Sequence
  source: /note="Description of Artificial Sequence: Synthetic oligonucleotide"
auugauggcaaagaagauagaag

SEQ ID NO: 573 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugatggcaaagaagauagaa

SEQ ID NO: 574 - RNA, 23 nt, Artificial Sequence
  source: /note="Description of Artificial Sequence: Synthetic oligonucleotide"
acuuugauggcaaagaagauaga

SEQ ID NO: 575 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutugauggcaaagaagauag

SEQ ID NO: 576 - RNA, 23 nt, Artificial Sequence
  source: /note="Description of Artificial Sequence: Synthetic oligonucleotide"
acaucuuugauggcaaagaagau

SEQ ID NO: 577 - RNA, 23 nt, Artificial Sequence
  source: /note="Description of Artificial Sequence: Synthetic oligonucleotide"
aauuaccugugugcugagcucga

SEQ ID NO: 578 - RNA, 23 nt, Artificial Sequence
  source: /note="Description of Artificial Sequence: Synthetic oligonucleotide"
aguuauuaccugugugcugagcu

SEQ ID NO: 579 - RNA, 23 nt, Artificial Sequence
  source: /note="Description of Artificial Sequence: Synthetic oligonucleotide"
acguuauuaccugugugcugagc

SEQ ID NO: 580 - RNA, 23 nt, Artificial Sequence
  source: /note="Description of Artificial Sequence: Synthetic oligonucleotide"
aacguuauuaccugugugcugag

SEQ ID NO: 581 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucctucacguuauuaccugugu

SEQ ID NO: 582 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccutcacguuauuaccugug

SEQ ID NO: 583 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguucctucacguuauuaccugu

SEQ ID NO: 584 - RNA, 23 nt, Artificial Sequence
  source: /note="Description of Artificial Sequence: Synthetic oligonucleotide"
agaagaguuccuucacguuauua

SEQ ID NO: 585 - RNA, 23 nt, Artificial Sequence
  source: /note="Description of Artificial Sequence: Synthetic oligonucleotide"
aggaagaguuccuucacguuauu

SEQ ID NO: 586 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagggutugcaguuuucugggac

SEQ ID NO: 587 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatagauccauguucuguggu

SEQ ID NO: 588 - RNA, 23 nt, Artificial Sequence
  source: /note="Description of Artificial Sequence: Synthetic oligonucleotide"
auuaauagauccauguucugugg

SEQ ID NO: 589 - RNA, 23 nt, Artificial Sequence
  source: /note="Description of Artificial Sequence: Synthetic oligonucleotide"
auuuaauagauccauguucugug

SEQ ID NO: 590 - RNA, 23 nt, Artificial Sequence
  source: /note="Description of Artificial Sequence: Synthetic oligonucleotide"
acuuuaauagauccauguucugu

SEQ ID NO: 591 - RNA, 23 nt, Artificial Sequence
  source: /note="Description of Artificial Sequence: Synthetic oligonucleotide"
aacuuuaauagauccauguucug

SEQ ID NO: 592 - RNA, 23 nt, Artificial Sequence
  source: /note="Description of Artificial Sequence: Synthetic oligonucleotide"
agacuuuaauagauccauguucu

SEQ ID NO: 593 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augacutuaauagauccauguuc

SEQ ID NO: 594 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugactuuaauagauccauguu

SEQ ID NO: 595 - RNA, 23 nt, Artificial Sequence
  source: /note="Description of Artificial Sequence: Synthetic oligonucleotide"
augugacuuuaauagauccaugu

SEQ ID NO: 596 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgacuuuaauagauccaug

SEQ ID NO: 597 - RNA, 23 nt, Artificial Sequence
  source: /note="Description of Artificial Sequence: Synthetic oligonucleotide"
aucugugacuuuaauagauccau

SEQ ID NO: 598 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgtgacuuuaauagaucca

SEQ ID NO: 599 - RNA, 23 nt, Artificial Sequence
  source: /note="Description of Artificial Sequence: Synthetic oligonucleotide"
auugaauuugcuuaucauugugu

SEQ ID NO: 600 - RNA, 23 nt, Artificial Sequence
  source: /note="Description of Artificial Sequence: Synthetic oligonucleotide"
auuugaauuugcuuaucauugug

SEQ ID NO: 601 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutugaauuugcuuaucauug

SEQ ID NO: 602 - RNA, 23 nt, Artificial Sequence
  source: /note="Description of Artificial Sequence: Synthetic oligonucleotide"
acauauucaccauuuaggcauaa

SEQ ID NO: 603 - RNA, 23 nt, Artificial Sequence
  source: /note="Description of Artificial Sequence: Synthetic oligonucleotide"
agcauauucaccauuuaggcaua

SEQ ID NO: 604 - RNA, 23 nt, Artificial Sequence
  source: /note="Description of Artificial Sequence: Synthetic oligonucleotide"
augcauauucaccauuuaggcau

SEQ ID NO: 605 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugcatauucaccauuuaggca

SEQ ID NO: 606 - RNA, 23 nt, Artificial Sequence
  source: /note="Description of Artificial Sequence: Synthetic oligonucleotide"
aauugcauauucaccauuuaggc

SEQ ID NO: 607 - RNA, 23 nt, Artificial Sequence
  source: /note="Description of Artificial Sequence: Synthetic oligonucleotide"
acuaauugcauauucaccauuua

SEQ ID NO: 608 - RNA, 23 nt, Artificial Sequence
  source: /note="Description of Artificial Sequence: Synthetic oligonucleotide"
aaauagcacaaacccuucccgac

SEQ ID NO: 609 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatagcacaaacccuucccga

SEQ ID NO: 610 - RNA, 23 nt, Artificial Sequence
  source: /note="Description of Artificial Sequence: Synthetic oligonucleotide"
aggaauagcacaaacccuucccg

SEQ ID NO: 611 - RNA, 23 nt, Artificial Sequence
  source: /note="Description of Artificial Sequence: Synthetic oligonucleotide"
aaucagaacuugagguuauacag

SEQ ID NO: 612 - RNA, 23 nt, Artificial Sequence
  source: /note="Description of Artificial Sequence: Synthetic oligonucleotide"
acaucagaacuugagguuauaca

SEQ ID NO: 613 - RNA, 23 nt, Artificial Sequence
  source: /note="Description of Artificial Sequence: Synthetic oligonucleotide"
agacaccaucagaacuugagguu

SEQ ID NO: 614 - RNA, 23 nt, Artificial Sequence
  source: /note="Description of Artificial Sequence: Synthetic oligonucleotide"
aacagacaccaucagaacuugag

SEQ ID NO: 615 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcutcuagagguuuguggga

SEQ ID NO: 616 - RNA, 23 nt, Artificial Sequence
  source: /note="Description of Artificial Sequence: Synthetic oligonucleotide"
auuaagcuucuagagguuugugg

SEQ ID NO: 617 - RNA, 23 nt, Artificial Sequence
  source: /note="Description of Artificial Sequence: Synthetic oligonucleotide"
aguuuaagcuucuagagguuugu

SEQ ID NO: 618 - RNA, 23 nt, Artificial Sequence
  source: /note="Description of Artificial Sequence: Synthetic oligonucleotide"
agguuuaagcuucuagagguuug

SEQ ID NO: 619 - RNA, 23 nt, Artificial Sequence
  source: /note="Description of Artificial Sequence: Synthetic oligonucleotide"
aguucauugguuugaaggccagg

SEQ ID NO: 620 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutcauugguuugaaggccag

SEQ ID NO: 621 - RNA, 23 nt, Artificial Sequence
  source: /note="Description of Artificial Sequence: Synthetic oligonucleotide"
acuguucauugguuugaaggcca

SEQ ID NO: 622 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugctguucauugguuugaag

SEQ ID NO: 623 - RNA, 23 nt, Artificial Sequence
  source: /note="Description of Artificial Sequence: Synthetic oligonucleotide"
aaagguuaugcuuugcuguucau

SEQ ID NO: 624 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaggtuaugcuuugcuguuca

SEQ ID NO: 625 - RNA, 23 nt, Artificial Sequence
  source: /note="Description of Artificial Sequence: Synthetic oligonucleotide"
aauucaagguuaugcuuugcugu

SEQ ID NO: 626 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautcaagguuaugcuuugcug

SEQ ID NO: 627 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatucaagguuaugcuuugcu

SEQ ID NO: 628 - RNA, 23 nt, Artificial Sequence
  source: /note="Description of Artificial Sequence: Synthetic oligonucleotide"
aguauagauucaagguuaugcuu

SEQ ID NO: 629 - RNA, 23 nt, Artificial Sequence
  source: /note="Description of Artificial Sequence: Synthetic oligonucleotide"
aaguauagauucaagguuaugcu

SEQ ID NO: 630 - RNA, 23 nt, Artificial Sequence
  source: /note="Description of Artificial Sequence: Synthetic oligonucleotide"
agaguauagauucaagguuaugc

SEQ ID NO: 631 - RNA, 23 nt, Artificial Sequence
  source: /note="Description of Artificial Sequence: Synthetic oligonucleotide"
augaguauagauucaagguuaug

SEQ ID NO: 632 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugagtauagauucaagguuau

SEQ ID NO: 633 - RNA, 23 nt, Artificial Sequence
  source: /note="Description of Artificial Sequence: Synthetic oligonucleotide"
auuugaguauagauucaagguua

SEQ ID NO: 634 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutgaguauagauucaagguu

SEQ ID NO: 635 - RNA, 23 nt, Artificial Sequence
  source: /note="Description of Artificial Sequence: Synthetic oligonucleotide"
agcaaaauuugaguauagauuca

SEQ ID NO: 636 - RNA, 23 nt, Artificial Sequence
  source: /note="Description of Artificial Sequence: Synthetic oligonucleotide"
augcaaaauuugaguauagauuc

SEQ ID NO: 637 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauggtuagaggauuuaaccuu

SEQ ID NO: 638 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagatgguuagaggauuuaac

SEQ ID NO: 639 - RNA, 23 nt, Artificial Sequence
  source: /note="Description of Artificial Sequence: Synthetic oligonucleotide"
acaaagaugguuagaggauuuaa

SEQ ID NO: 640 - RNA, 23 nt, Artificial Sequence
  source: /note="Description of Artificial Sequence: Synthetic oligonucleotide"
aucaaagaugguuagaggauuua

SEQ ID NO: 641 - RNA, 23 nt, Artificial Sequence
  source: /note="Description of Artificial Sequence: Synthetic oligonucleotide"
auucaaagaugguuagaggauuu

SEQ ID NO: 642 - RNA, 23 nt, Artificial Sequence
  source: /note="Description of Artificial Sequence: Synthetic oligonucleotide"
aauucaaagaugguuagaggauu

SEQ ID NO: 643 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautcaaagaugguuagaggau

SEQ ID NO: 644 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatucaaagaugguuagagga

SEQ ID NO: 645 - RNA, 23 nt, Artificial Sequence
  source: /note="Description of Artificial Sequence: Synthetic oligonucleotide"
aaugauucaaagaugguuagagg

SEQ ID NO: 646 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugatucaaagaugguuagag

SEQ ID NO: 647 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaatgauucaaagaugguuaga

SEQ ID NO: 648 - RNA, 23 nt, Artificial Sequence
  source: /note="Description of Artificial Sequence: Synthetic oligonucleotide"
accaaugauucaaagaugguuag

SEQ ID NO: 649 - RNA, 23 nt, Artificial Sequence
  source: /note="Description of Artificial Sequence: Synthetic oligonucleotide"
auuccaaugauucaaagaugguu

SEQ ID NO: 650 - RNA, 23 nt, Artificial Sequence
  source: /note="Description of Artificial Sequence: Synthetic oligonucleotide"
auuuccaaugauucaaagauggu

SEQ ID NO: 651 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuutccaaugauucaaagaugg

SEQ ID NO: 652 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctutccaaugauucaaagau

SEQ ID NO: 653 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutcauucuuuauucuuucca

SEQ ID NO: 654 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutucauucuuuauucuuucc

SEQ ID NO: 655 - RNA, 23 nt, Artificial Sequence
  source: /note="Description of Artificial Sequence: Synthetic oligonucleotide"
aaccuugaauuuguuucauucuu

SEQ ID NO: 656 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacctugaauuuguuucauuc

SEQ ID NO: 657 - RNA, 23 nt, Artificial Sequence
  source: /note="Description of Artificial Sequence: Synthetic oligonucleotide"
acaauuaaccuugaauuuguuuc

SEQ ID NO: 658 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutgcuuuaugcagcuucaca

SEQ ID NO: 659 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaucutgcuuuaugcagcuuca

SEQ ID NO: 660 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatctugcuuuaugcagcuuc

SEQ ID NO: 661 - RNA, 23 nt, Artificial Sequence
  source: /note="Description of Artificial Sequence: Synthetic oligonucleotide"
aguaaucuugcuuuaugcagcuu

SEQ ID NO: 662 - RNA, 23 nt, Artificial Sequence
  source: /note="Description of Artificial Sequence: Synthetic oligonucleotide"
aaguaaucuugcuuuaugcagcu

SEQ ID NO: 663 - RNA, 23 nt, Artificial Sequence
  source: /note="Description of Artificial Sequence: Synthetic oligonucleotide"
agaguaaucuugcuuuaugcagc

SEQ ID NO: 664 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagagtaaucuugcuuuaugca

SEQ ID NO: 665 - RNA, 23 nt, Artificial Sequence
  source: /note="Description of Artificial Sequence: Synthetic oligonucleotide"
auauagaguaaucuugcuuuaug

SEQ ID NO: 666 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutgguuggauuuuuguauua

SEQ ID NO: 667 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtugguuggauuuuuguauu

SEQ ID NO: 668 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagutgguuggauuuuuguau

SEQ ID NO: 669 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugagtugguuggauuuuugua

SEQ ID NO: 670 - RNA, 23 nt, Artificial Sequence
  source: /note="Description of Artificial Sequence: Synthetic oligonucleotide"
aauugaguugguuggauuuuugu

SEQ ID NO: 671 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgaguugguuggauuuuug

SEQ ID NO: 672 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatugaguugguuggauuuuu

SEQ ID NO: 673 - RNA, 23 nt, Artificial Sequence
  source: /note="Description of Artificial Sequence: Synthetic oligonucleotide"
aauaauugaguugguuggauuuu

SEQ ID NO: 674 - RNA, 23 nt, Artificial Sequence
  source: /note="Description of Artificial Sequence: Synthetic oligonucleotide"
aaauaauugaguugguuggauuu

SEQ ID NO: 675 - RNA, 23 nt, Artificial Sequence
  source: /note="Description of Artificial Sequence: Synthetic oligonucleotide"
acaauaauugaguugguuggauu

SEQ ID NO: 676 - RNA, 23 nt, Artificial Sequence
  source: /note="Description of Artificial Sequence: Synthetic oligonucleotide"
aucaauaauugaguugguuggau

SEQ ID NO: 677 - RNA, 23 nt, Artificial Sequence
  source: /note="Description of Artificial Sequence: Synthetic oligonucleotide"
acucaauaauugaguugguugga

SEQ ID NO: 678 - RNA, 23 nt, Artificial Sequence
  source: /note="Description of Artificial Sequence: Synthetic oligonucleotide"
agcucaauaauugaguugguugg

SEQ ID NO: 679 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctcaauaauugaguugguug

SEQ ID NO: 680 - RNA, 23 nt, Artificial Sequence
  source: /note="Description of Artificial Sequence: Synthetic oligonucleotide"
agugcucaauaauugaguugguu

SEQ ID NO: 681 - RNA, 23 nt, Artificial Sequence
  source: /note="Description of Artificial Sequence: Synthetic oligonucleotide"
agaaaucuagaacauuguacgug

SEQ ID NO: 682 - RNA, 23 nt, Artificial Sequence
  source: /note="Description of Artificial Sequence: Synthetic oligonucleotide"
aagaaaucuagaacauuguacgu

SEQ ID NO: 683 - RNA, 23 nt, Artificial Sequence
  source: /note="Description of Artificial Sequence: Synthetic oligonucleotide"
aaagaaaucuagaacauuguacg

SEQ ID NO: 684 - RNA, 23 nt, Artificial Sequence
  source: /note="Description of Artificial Sequence: Synthetic oligonucleotide"
aaaagaaaucuagaacauuguac

SEQ ID NO: 685 - RNA, 23 nt, Artificial Sequence
  source: /note="Description of Artificial Sequence: Synthetic oligonucleotide"
agaaagaaaucuagaacauugua

SEQ ID NO: 686 - RNA, 23 nt, Artificial Sequence
  source: /note="Description of Artificial Sequence: Synthetic oligonucleotide"
aggaaagaaaucuagaacauugu

SEQ ID NO: 687 - RNA, 23 nt, Artificial Sequence
  source: /note="Description of Artificial Sequence: Synthetic oligonucleotide"
aaagggaaagaaaucuagaacau

SEQ ID NO: 688 - RNA, 23 nt, Artificial Sequence
  source: /note="Description of Artificial Sequence: Synthetic oligonucleotide"
agaagggaaagaaaucuagaaca

SEQ ID NO: 689 - RNA, 23 nt, Artificial Sequence
  source: /note="Description of Artificial Sequence: Synthetic oligonucleotide"
auuuggcuucaaauguaaagauu

SEQ ID NO: 690 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuutggcuucaaauguaaagau

SEQ ID NO: 691 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacutuggcuucaaauguaaaga

SEQ ID NO: 692 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuactuuggcuucaaauguaa

SEQ ID NO: 693 - RNA, 23 nt, Artificial Sequence
  source: /note="Description of Artificial Sequence: Synthetic oligonucleotide"
aaaauuacuuuggcuucaaaugu

SEQ ID NO: 694 - RNA, 23 nt, Artificial Sequence
  source: /note="Description of Artificial Sequence: Synthetic oligonucleotide"
aguggaaauuacuuuggcuucaa

SEQ ID NO: 695 - RNA, 23 nt, Artificial Sequence
  source: /note="Description of Artificial Sequence: Synthetic oligonucleotide"
agguggaaauuacuuuggcuuca

SEQ ID NO: 696 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuaggtggaaauuacuuuggcu

SEQ ID NO: 697 - RNA, 23 nt, Artificial Sequence
  source: /note="Description of Artificial Sequence: Synthetic oligonucleotide"
aucuagguggaaauuacuuuggc

SEQ ID NO: 698 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctagguggaaauuacuuugg

SEQ ID NO: 699 - RNA, 23 nt, Artificial Sequence
  source: /note="Description of Artificial Sequence: Synthetic oligonucleotide"
acuucagagacaagaucuugcuc

SEQ ID NO: 700 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutctuggcucuucuaccucu

SEQ ID NO: 701 - RNA, 23 nt, Artificial Sequence
  source: /note="Description of Artificial Sequence: Synthetic oligonucleotide"
agacagaagagacagagcuagga

SEQ ID NO: 702 - RNA, 23 nt, Artificial Sequence
  source: /note="Description of Artificial Sequence: Synthetic oligonucleotide"
aagacagaagagacagagcuagg

SEQ ID NO: 703 - RNA, 23 nt, Artificial Sequence
  source: /note="Description of Artificial Sequence: Synthetic oligonucleotide"
agagacagaagagacagagcuag

SEQ ID NO: 704 - RNA, 23 nt, Artificial Sequence
  source: /note="Description of Artificial Sequence: Synthetic oligonucleotide"
acaguccaagaucacaaagauag

SEQ ID NO: 705 - RNA, 23 nt, Artificial Sequence
  source: /note="Description of Artificial Sequence: Synthetic oligonucleotide"
aguaaaauggaucacaggaaggg

SEQ ID NO: 706 - RNA, 23 nt, Artificial Sequence
  source: /note="Description of Artificial Sequence: Synthetic oligonucleotide"
aaguaaaauggaucacaggaagg

SEQ ID NO: 707 - RNA, 23 nt, Artificial Sequence
  source: /note="Description of Artificial Sequence: Synthetic oligonucleotide"
acaguaaaauggaucacaggaag

SEQ ID NO: 708 - RNA, 23 nt, Artificial Sequence
  source: /note="Description of Artificial Sequence: Synthetic oligonucleotide"
agcaguaaaauggaucacaggaa

SEQ ID NO: 709 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcagtaaaauggaucacagga

SEQ ID NO: 710 - RNA, 23 nt, Artificial Sequence
  source: /note="Description of Artificial Sequence: Synthetic oligonucleotide"
auucaggucauauauuuauaggc

SEQ ID NO: 711 - RNA, 23 nt, Artificial Sequence
  source: /note="Description of Artificial Sequence: Synthetic oligonucleotide"
auaacuggaguuuucaggucaua

SEQ ID NO: 712 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaactggaguuuucaggucau

SEQ ID NO: 713 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagatagcugcagauccuuua

SEQ ID NO: 714 - RNA, 23 nt, Artificial Sequence
  source: /note="Description of Artificial Sequence: Synthetic oligonucleotide"
acuuagauagcugcagauccuuu

SEQ ID NO: 715 - RNA, 23 nt, Artificial Sequence
  source: /note="Description of Artificial Sequence: Synthetic oligonucleotide"
aaaaaccaagccuuagauagcug

SEQ ID NO: 716 - RNA, 23 nt, Artificial Sequence
  source: /note="Description of Artificial Sequence: Synthetic oligonucleotide"
agaaaaccaagccuuagauagcu

SEQ ID NO: 717 - RNA, 23 nt, Artificial Sequence
  source: /note="Description of Artificial Sequence: Synthetic oligonucleotide"
aaagaaaaccaagccuuagauag

SEQ ID NO: 718 - RNA, 23 nt, Artificial Sequence
  source: /note="Description of Artificial Sequence: Synthetic oligonucleotide"
auaagaaaaccaagccuuagaua

SEQ ID NO: 719 - RNA, 23 nt, Artificial Sequence
  source: /note="Description of Artificial Sequence: Synthetic oligonucleotide"
aguaagaaaaccaagccuuagau

SEQ ID NO: 720 - RNA, 23 nt, Artificial Sequence
  source: /note="Description of Artificial Sequence: Synthetic oligonucleotide"
aaguaagaaaaccaagccuuaga

SEQ ID NO: 721 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacagtaagaaaaccaagccuu

SEQ ID NO: 722 - RNA, 23 nt, Artificial Sequence
  source: /note="Description of Artificial Sequence: Synthetic oligonucleotide"
augacaguaagaaaaccaagccu

SEQ ID NO: 723 - RNA, 23 nt, Artificial Sequence
  source: /note="Description of Artificial Sequence: Synthetic oligonucleotide"
aaugacaguaagaaaaccaagcc

SEQ ID NO: 724 - RNA, 23 nt, Artificial Sequence
  source: /note="Description of Artificial Sequence: Synthetic oligonucleotide"
auaugacaguaagaaaaccaagc

SEQ ID NO: 725 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatgacaguaagaaaaccaag

SEQ ID NO: 726 - RNA, 23 nt, Artificial Sequence
  source: /note="Description of Artificial Sequence: Synthetic oligonucleotide"
acauaugacaguaagaaaaccaa

SEQ ID NO: 727 - RNA, 23 nt, Artificial Sequence
  source: /note="Description of Artificial Sequence: Synthetic oligonucleotide"
aaucauaugacaguaagaaaacc

SEQ ID NO: 728 - RNA, 23 nt, Artificial Sequence
  source: /note="Description of Artificial Sequence: Synthetic oligonucleotide"
auaucauaugacaguaagaaaac

SEQ ID NO: 729 - RNA, 23 nt, Artificial Sequence
  source: /note="Description of Artificial Sequence: Synthetic oligonucleotide"
agguaucauaugacaguaagaaa

SEQ ID NO: 730 - RNA, 23 nt, Artificial Sequence
  source: /note="Description of Artificial Sequence: Synthetic oligonucleotide"
aagguaucauaugacaguaagaa

SEQ ID NO: 731 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctctuuaccaaccgcagaaa

SEQ ID NO: 732 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugtagggauuaaaucaccauu

SEQ ID NO: 733 - RNA, 23 nt, Artificial Sequence
  source: /note="Description of Artificial Sequence: Synthetic oligonucleotide"
acauguagggauuaaaucaccau

SEQ ID NO: 734 - RNA, 23 nt, Artificial Sequence
  source: /note="Description of Artificial Sequence: Synthetic oligonucleotide"
acagaagguuggauuuauacagu

SEQ ID NO: 735 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuatuagugacaucaagcacca

SEQ ID NO: 736 - RNA, 23 nt, Artificial Sequence
  source: /note="Description of Artificial Sequence: Synthetic oligonucleotide"
auuuauuagugacaucaagcacc

SEQ ID NO: 737 - RNA, 23 nt, Artificial Sequence
  source: /note="Description of Artificial Sequence: Synthetic oligonucleotide"
aauuuauuagugacaucaagcac

SEQ ID NO: 738 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutcauuuauuagugacauca

SEQ ID NO: 739 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutucauuuauuagugacauc

SEQ ID NO: 740 - RNA, 23 nt, Artificial Sequence
  source: /note="Description of Artificial Sequence: Synthetic oligonucleotide"
agcugacaguuucauuuauuagu

SEQ ID NO: 741 - RNA, 21 nt, Artificial Sequence
  source: /note="Description of Artificial Sequence: Synthetic oligonucleotide"
uaccugccagugucucuuagu

SEQ ID NO: 742 - RNA, 21 nt, Artificial Sequence
  source: /note="Description of Artificial Sequence: Synthetic oligonucleotide"
accugccagugucucuuaggu

SEQ ID NO: 743 - RNA, 21 nt, Artificial Sequence
  source: /note="Description of Artificial Sequence: Synthetic oligonucleotide"
ccugccagugucucuuaggau

SEQ ID NO: 744 - RNA, 21 nt, Artificial Sequence
  source: /note="Description of Artificial Sequence: Synthetic oligonucleotide"
ugccagugucucuuaggaguu

SEQ ID NO: 745 - RNA, 21 nt, Artificial Sequence
  source: /note="Description of Artificial Sequence: Synthetic oligonucleotide"
gccagugucucuuaggagugu

SEQ ID NO: 746 - RNA, 21 nt, Artificial Sequence
  source: /note="Description of Artificial Sequence: Synthetic oligonucleotide"
ccagugucucuuaggagugau

SEQ ID NO: 747 - RNA, 21 nt, Artificial Sequence
  source: /note="Description of Artificial Sequence: Synthetic oligonucleotide"
cagugucucuuaggagugagu

SEQ ID NO: 748 - RNA, 21 nt, Artificial Sequence
  source: /note="Description of Artificial Sequence: Synthetic oligonucleotide"
agugucucuuaggagugaggu

SEQ ID NO: 749 - RNA, 21 nt, Artificial Sequence
  source: /note="Description of Artificial Sequence: Synthetic oligonucleotide"
uggagaaaaaugcagauccau

SEQ ID NO: 750 - RNA, 21 nt, Artificial Sequence
  source: /note="Description of Artificial Sequence: Synthetic oligonucleotide"
ccagagacaacccuuuuggcu

SEQ ID NO: 751 - RNA, 21 nt, Artificial Sequence
  source: /note="Description of Artificial Sequence: Synthetic oligonucleotide"
agagacaacccuuuuggccuu

SEQ ID NO: 752 - RNA, 21 nt, Artificial Sequence
  source: /note="Description of Artificial Sequence: Synthetic oligonucleotide"
gcacagugaugcucuccaagu

SEQ ID NO: 753 - RNA, 21 nt, Artificial Sequence
  source: /note="Description of Artificial Sequence: Synthetic oligonucleotide"
cacagugaugcucuccaaguu

SEQ ID NO: 754 - RNA, 21 nt, Artificial Sequence
  source: /note="Description of Artificial Sequence: Synthetic oligonucleotide"
gaugcucuccaaguaugaucu

SEQ ID NO: 755 - RNA, 21 nt, Artificial Sequence
  source: /note="Description of Artificial Sequence: Synthetic oligonucleotide"
augcucuccaaguaugaucgu

SEQ ID NO: 756 - RNA, 21 nt, Artificial Sequence
  source: /note="Description of Artificial Sequence: Synthetic oligonucleotide"
ugcucuccaaguaugaucguu

SEQ ID NO: 757 - RNA, 21 nt, Artificial Sequence
  source: /note="Description of Artificial Sequence: Synthetic oligonucleotide"
gcucuccaaguaugaucgucu

SEQ ID NO: 758 - RNA, 21 nt, Artificial Sequence
  source: /note="Description of Artificial Sequence: Synthetic oligonucleotide"
cucuccaaguaugaucgucuu

SEQ ID NO: 759 - RNA, 21 nt, Artificial Sequence
  source: /note="Description of Artificial Sequence: Synthetic oligonucleotide"
gaucgucugcagaacaagauu

SEQ ID NO: 760 - RNA, 21 nt, Artificial Sequence
  source: /note="Description of Artificial Sequence: Synthetic oligonucleotide"
cgucugcagaacaagaucguu

SEQ ID NO: 761 - RNA, 21 nt, Artificial Sequence
  source: /note="Description of Artificial Sequence: Synthetic oligonucleotide"
gucugcagaacaagaucgucu

SEQ ID NO: 762 - RNA, 21 nt, Artificial Sequence
  source: /note="Description of Artificial Sequence: Synthetic oligonucleotide"
ucugcagaacaagaucguccu

SEQ ID NO: 763 - RNA, 21 nt, Artificial Sequence
  source: /note="Description of Artificial Sequence: Synthetic oligonucleotide"
gcagaacaagaucguccacuu

SEQ ID NO: 764 - RNA, 21 nt, Artificial Sequence
  source: /note="Description of Artificial Sequence: Synthetic oligonucleotide"
cagaacaagaucguccacuuu

SEQ ID NO: 765 - RNA, 21 nt, Artificial Sequence
  source: /note="Description of Artificial Sequence: Synthetic oligonucleotide"
gaacaagaucguccacuuuuu

SEQ ID NO: 766 - RNA, 21 nt, Artificial Sequence
  source: /note="Description of Artificial Sequence: Synthetic oligonucleotide"
aacaagaucguccacuuuucu

SEQ ID NO: 767 - RNA, 21 nt, Artificial Sequence
  source: /note="Description of Artificial Sequence: Synthetic oligonucleotide"
acaagaucguccacuuuucuu

SEQ ID NO: 768 - RNA, 21 nt, Artificial Sequence
  source: /note="Description of Artificial Sequence: Synthetic oligonucleotide"
caagaucguccacuuuucugu

SEQ ID NO: 769 - RNA, 21 nt, Artificial Sequence
  source: /note="Description of Artificial Sequence: Synthetic oligonucleotide"
aagaucguccacuuuucugcu

SEQ ID NO: 770 - RNA, 21 nt, Artificial Sequence
  source: /note="Description of Artificial Sequence: Synthetic oligonucleotide"
cguccacuuuucugccaaugu

SEQ ID NO: 771 - RNA, 21 nt, Artificial Sequence
  source: /note="Description of Artificial Sequence: Synthetic oligonucleotide"
guccacuuuucugccaaugcu

SEQ ID NO: 772 - RNA, 21 nt, Artificial Sequence
  source: /note="Description of Artificial Sequence: Synthetic oligonucleotide"
ugcuccuugcaccauguugcu

SEQ ID NO: 773 - RNA, 21 nt, Artificial Sequence
  source: /note="Description of Artificial Sequence: Synthetic oligonucleotide"
uccuugcaccauguugcaguu

SEQ ID NO: 774 - RNA, 21 nt, Artificial Sequence
  source: /note="Description of Artificial Sequence: Synthetic oligonucleotide"
uugcaccauguugcagugacu

SEQ ID NO: 775 - RNA, 21 nt, Artificial Sequence
  source: /note="Description of Artificial Sequence: Synthetic oligonucleotide"
caccauguugcagugacaacu

SEQ ID NO: 776 - RNA, 21 nt, Artificial Sequence
  source: /note="Description of Artificial Sequence: Synthetic oligonucleotide"
accauguugcagugacaacuu

SEQ ID NO: 777 - RNA, 21 nt, Artificial Sequence
  source: /note="Description of Artificial Sequence: Synthetic oligonucleotide"
aggagagaauugccaaaagcu

SEQ ID NO: 778 - RNA, 21 nt, Artificial Sequence
  source: /note="Description of Artificial Sequence: Synthetic oligonucleotide"
ggagagaauugccaaaagccu

SEQ ID NO: 779 - RNA, 21 nt, Artificial Sequence
  source: /note="Description of Artificial Sequence: Synthetic oligonucleotide"
uggcaucgucaugaguauguu

SEQ ID NO: 780 - RNA, 21 nt, Artificial Sequence
  source: /note="Description of Artificial Sequence: Synthetic oligonucleotide"
ggcaucgucaugaguauguau

SEQ ID NO: 781 - RNA, 21 nt, Artificial Sequence
  source: /note="Description of Artificial Sequence: Synthetic oligonucleotide"
gcaucgucaugaguauguacu

SEQ ID NO: 782 - RNA, 21 nt, Artificial Sequence
  source: /note="Description of Artificial Sequence: Synthetic oligonucleotide"
caucgucaugaguauguacau

SEQ ID NO: 783 - RNA, 21 nt, Artificial Sequence
  source: /note="Description of Artificial Sequence: Synthetic oligonucleotide"
aucgucaugaguauguacacu

SEQ ID NO: 784 - RNA, 21 nt, Artificial Sequence
  source: /note="Description of Artificial Sequence: Synthetic oligonucleotide"
cgucaugaguauguacacacu

SEQ ID NO: 785 - RNA, 21 nt, Artificial Sequence
  source: /note="Description of Artificial Sequence: Synthetic oligonucleotide"
gucaugaguauguacacacuu

SEQ ID NO: 786 - RNA, 21 nt, Artificial Sequence
  source: /note="Description of Artificial Sequence: Synthetic oligonucleotide"
ucaugaguauguacacacugu

SEQ ID NO: 787 - RNA, 21 nt, Artificial Sequence
  source: /note="Description of Artificial Sequence: Synthetic oligonucleotide"
aaugccuuccaaggaaaucuu

SEQ ID NO: 788 - RNA, 21 nt, Artificial Sequence
  source: /note="Description of Artificial Sequence: Synthetic oligonucleotide"
augccuuccaaggaaaucugu

SEQ ID NO: 789 - RNA, 21 nt, Artificial Sequence
  source: /note="Description of Artificial Sequence: Synthetic oligonucleotide"
ugccuuccaaggaaaucuguu

SEQ ID NO: 790 - RNA, 21 nt, Artificial Sequence
  source: /note="Description of Artificial Sequence: Synthetic oligonucleotide"
gccuuccaaggaaaucugugu

SEQ ID NO: 791 - RNA, 21 nt, Artificial Sequence
  source: /note="Description of Artificial Sequence: Synthetic oligonucleotide"
ccuuccaaggaaaucugugcu

SEQ ID NO: 792 - RNA, 21 nt, Artificial Sequence
  source: /note="Description of Artificial Sequence: Synthetic oligonucleotide"
gagaugaaguucaagaauauu

SEQ ID NO: 793 - RNA, 21 nt, Artificial Sequence
  source: /note="Description of Artificial Sequence: Synthetic oligonucleotide"
gaugaaguucaagaauaugcu

SEQ ID NO: 794 - RNA, 21 nt, Artificial Sequence
  source: /note="Description of Artificial Sequence: Synthetic oligonucleotide"
aaguucaagaauaugcuguuu

SEQ ID NO: 795 - RNA, 21 nt, Artificial Sequence
  source: /note="Description of Artificial Sequence: Synthetic oligonucleotide"
aguucaagaauaugcuguuuu

SEQ ID NO: 796 - RNA, 21 nt, Artificial Sequence
  source: /note="Description of Artificial Sequence: Synthetic oligonucleotide"
guucaagaauaugcuguuucu

SEQ ID NO: 797 - RNA, 21 nt, Artificial Sequence
  source: /note="Description of Artificial Sequence: Synthetic oligonucleotide"
uucaagaauaugcuguuuccu

SEQ ID NO: 798 - RNA, 21 nt, Artificial Sequence
  source: /note="Description of Artificial Sequence: Synthetic oligonucleotide"
aagaauaugcuguuuccuauu

SEQ ID NO: 799 - RNA, 21 nt, Artificial Sequence
  source: /note="Description of Artificial Sequence: Synthetic oligonucleotide"
gggaguauuucucagcauucu

SEQ ID NO: 800 - RNA, 21 nt, Artificial Sequence
  source: /note="Description of Artificial Sequence: Synthetic oligonucleotide"
ggaguauuucucagcauucau

SEQ ID NO: 801 - RNA, 21 nt, Artificial Sequence
  source: /note="Description of Artificial Sequence: Synthetic oligonucleotide"
gaguauuucucagcauucaau

SEQ ID NO: 802 - RNA, 21 nt, Artificial Sequence
  source: /note="Description of Artificial Sequence: Synthetic oligonucleotide"
aguauuucucagcauucaagu

SEQ ID NO: 803 - RNA, 21 nt, Artificial Sequence
  source: /note="Description of Artificial Sequence: Synthetic oligonucleotide"
guauuucucagcauucaagcu

SEQ ID NO: 804 - RNA, 21 nt, Artificial Sequence
  source: /note="Description of Artificial Sequence: Synthetic oligonucleotide"
guggcaugagaguuuuauucu

SEQ ID NO: 805 - RNA, 21 nt, Artificial Sequence
  source: /note="Description of Artificial Sequence: Synthetic oligonucleotide"
ggcaugagaguuuuauucaau

SEQ ID NO: 806 - RNA, 21 nt, Artificial Sequence
  source: /note="Description of Artificial Sequence: Synthetic oligonucleotide"
caugagaguuuuauucaagcu

SEQ ID NO: 807 - RNA, 21 nt, Artificial Sequence
  source: /note="Description of Artificial Sequence: Synthetic oligonucleotide"
ccucacccucagcuucuucuu

SEQ ID NO: 808 - RNA, 21 nt, Artificial Sequence
  source: /note="Description of Artificial Sequence: Synthetic oligonucleotide"
ucacccucagcuucuucuucu

SEQ ID NO: 809 - RNA, 21 nt, Artificial Sequence
  source: /note="Description of Artificial Sequence: Synthetic oligonucleotide"
ucuucaaguucuaccugacau

SEQ ID NO: 810 - RNA, 21 nt, Artificial Sequence
  source: /note="Description of Artificial Sequence: Synthetic oligonucleotide"
uuucgccagugcaacuuuacu

SEQ ID NO: 811 - RNA, 21 nt, Artificial Sequence
  source: /note="Description of Artificial Sequence: Synthetic oligonucleotide"
uucgccagugcaacuuuacuu

SEQ ID NO: 812 - RNA, 21 nt, Artificial Sequence
  source: /note="Description of Artificial Sequence: Synthetic oligonucleotide"
uuccaggguuuguuuguuucu

SEQ ID NO: 813 - RNA, 21 nt, Artificial Sequence
  source: /note="Description of Artificial Sequence: Synthetic oligonucleotide"
caggguuuguuuguuucauuu

SEQ ID NO: 814 - RNA, 21 nt, Artificial Sequence
  source: /note="Description of Artificial Sequence: Synthetic oligonucleotide"
ggguuuguuuguuucauuucu

SEQ ID NO: 815 - RNA, 21 nt, Artificial Sequence
  source: /note="Description of Artificial Sequence: Synthetic oligonucleotide"
gguuuguuuguuucauuuccu

SEQ ID NO: 816 - RNA, 21 nt, Artificial Sequence
  source: /note="Description of Artificial Sequence: Synthetic oligonucleotide"
uuguuuguuucauuuccgcuu

SEQ ID NO: 817 - RNA, 21 nt, Artificial Sequence
  source: /note="Description of Artificial Sequence: Synthetic oligonucleotide"
uuccugggaguaacauaacuu

SEQ ID NO: 818 - RNA, 21 nt, Artificial Sequence
  source: /note="Description of Artificial Sequence: Synthetic oligonucleotide"
gggaguaacauaacuggaauu

SEQ ID NO: 819 - RNA, 21 nt, Artificial Sequence
  source: /note="Description of Artificial Sequence: Synthetic oligonucleotide"
uaacauaacuggaauuuguau

SEQ ID NO: 820 - RNA, 21 nt, Artificial Sequence
  source: /note="Description of Artificial Sequence: Synthetic oligonucleotide"
aacauaacuggaauuuguaau

SEQ ID NO: 821 - RNA, 21 nt, Artificial Sequence
  source: /note="Description of Artificial Sequence: Synthetic oligonucleotide"
cgaaggauaagguuacuuguu

SEQ ID NO: 822 - RNA, 21 nt, Artificial Sequence
  source: /note="Description of Artificial Sequence: Synthetic oligonucleotide"
gaaggauaagguuacuugugu

SEQ ID NO: 823 - RNA, 21 nt, Artificial Sequence
  source: /note="Description of Artificial Sequence: Synthetic oligonucleotide"
gggugaaaaucaccuaugaau

SEQ ID NO: 824 - RNA, 21 nt, Artificial Sequence
  source: /note="Description of Artificial Sequence: Synthetic oligonucleotide"
aaucaccuaugaagaacuacu

SEQ ID NO: 825 - RNA, 21 nt, Artificial Sequence
  source: /note="Description of Artificial Sequence: Synthetic oligonucleotide"
aucaccuaugaagaacuaccu

SEQ ID NO: 826 - RNA, 21 nt, Artificial Sequence
  source: /note="Description of Artificial Sequence: Synthetic oligonucleotide"
uaccagccauuaucacaauuu

SEQ ID NO: 827 - RNA, 21 nt, Artificial Sequence
  source: /note="Description of Artificial Sequence: Synthetic oligonucleotide"
gaacaacuccuuuuauggacu

SEQ ID NO: 828 - RNA, 21 nt, Artificial Sequence
  source: /note="Description of Artificial Sequence: Synthetic oligonucleotide"
ggccaagagcacuucuaccuu

SEQ ID NO: 829 - RNA, 21 nt, Artificial Sequence
  source: /note="Description of Artificial Sequence: Synthetic oligonucleotide"
gagcacuucuaccuggagacu

SEQ ID NO: 830 - RNA, 21 nt, Artificial Sequence
  source: /note="Description of Artificial Sequence: Synthetic oligonucleotide"
gcacuucuaccuggagacucu

SEQ ID NO: 831 - RNA, 21 nt, Artificial Sequence
  source: /note="Description of Artificial Sequence: Synthetic oligonucleotide"
cacuucuaccuggagacucau

SEQ ID NO: 832 - RNA, 21 nt, Artificial Sequence
  source: /note="Description of Artificial Sequence: Synthetic oligonucleotide"
ucacugcaccauugcuguucu

SEQ ID NO: 833 - RNA, 21 nt, Artificial Sequence
  source: /note="Description of Artificial Sequence: Synthetic oligonucleotide"
cacugcaccauugcuguuccu

SEQ ID NO: 834 - RNA, 21 nt, Artificial Sequence
  source: /note="Description of Artificial Sequence: Synthetic oligonucleotide"
ccauugcuguuccaaaaggcu

SEQ ID NO: 835 - RNA, 21 nt, Artificial Sequence
  source: /note="Description of Artificial Sequence: Synthetic oligonucleotide"
agcucuuugugucuacacagu

SEQ ID NO: 836 - RNA, 21 nt, Artificial Sequence
  source: /note="Description of Artificial Sequence: Synthetic oligonucleotide"
gcucuuugugucuacacagau

SEQ ID NO: 837 - RNA, 21 nt, Artificial Sequence
  source: /note="Description of Artificial Sequence: Synthetic oligonucleotide"
cucuuugugucuacacagaau

SEQ ID NO: 838 - RNA, 21 nt, Artificial Sequence
  source: /note="Description of Artificial Sequence: Synthetic oligonucleotide"
ucuuugugucuacacagaacu

SEQ ID NO: 839 - RNA, 21 nt, Artificial Sequence
  source: /note="Description of Artificial Sequence: Synthetic oligonucleotide"
cuuugugucuacacagaacau

SEQ ID NO: 840 - RNA, 21 nt, Artificial Sequence
  source: /note="Description of Artificial Sequence: Synthetic oligonucleotide"
uuugugucuacacagaacacu

SEQ ID NO: 841 - RNA, 21 nt, Artificial Sequence
  source: /note="Description of Artificial Sequence: Synthetic oligonucleotide"
acacagaacaccaugaagacu

SEQ ID NO: 842 - RNA, 21 nt, Artificial Sequence
  source: /note="Description of Artificial Sequence: Synthetic oligonucleotide"
gagcuuuguugcaaaaauguu

SEQ ID NO: 843 - RNA, 21 nt, Artificial Sequence
  source: /note="Description of Artificial Sequence: Synthetic oligonucleotide"
agcuuuguugcaaaaauguuu

SEQ ID NO: 844 - RNA, 21 nt, Artificial Sequence
  source: /note="Description of Artificial Sequence: Synthetic oligonucleotide"
aggaucucucucagaguauuu

SEQ ID NO: 845 - RNA, 21 nt, Artificial Sequence
  source: /note="Description of Artificial Sequence: Synthetic oligonucleotide"
ggaucucucucagaguauuau

SEQ ID NO: 846 - RNA, 21 nt, Artificial Sequence
  source: /note="Description of Artificial Sequence: Synthetic oligonucleotide"
gaucucucucagaguauuauu

SEQ ID NO: 847 - RNA, 21 nt, Artificial Sequence
  source: /note="Description of Artificial Sequence: Synthetic oligonucleotide"
aucucucucagaguauuaugu

SEQ ID NO: 848 - RNA, 21 nt, Artificial Sequence
  source: /note="Description of Artificial Sequence: Synthetic oligonucleotide"
ucucucucagaguauuauggu

SEQ ID NO: 849 - RNA, 21 nt, Artificial Sequence
  source: /note="Description of Artificial Sequence: Synthetic oligonucleotide"
cucucucagaguauuauggau

SEQ ID NO: 850 - RNA, 21 nt, Artificial Sequence
  source: /note="Description of Artificial Sequence: Synthetic oligonucleotide"
ucucucagaguauuauggaau

SEQ ID NO: 851 - RNA, 21 nt, Artificial Sequence
  source: /note="Description of Artificial Sequence: Synthetic oligonucleotide"
cucucagaguauuauggaacu

SEQ ID NO: 852 - RNA, 21 nt, Artificial Sequence
  source: /note="Description of Artificial Sequence: Synthetic oligonucleotide"
ucucagaguauuauggaacgu

SEQ ID NO: 853 - RNA, 21 nt, Artificial Sequence
  source: /note="Description of Artificial Sequence: Synthetic oligonucleotide"
ucagaguauuauggaacgagu

SEQ ID NO: 854 - RNA, 21 nt, Artificial Sequence
  source: /note="Description of Artificial Sequence: Synthetic oligonucleotide"
cagaguauuauggaacgagcu

SEQ ID NO: 855 - RNA, 21 nt, Artificial Sequence
  source: /note="Description of Artificial Sequence: Synthetic oligonucleotide"
gcugugcaaaaccaaccuucu

SEQ ID NO: 856 - RNA, 21 nt, Artificial Sequence
  source: /note="Description of Artificial Sequence: Synthetic oligonucleotide"
cugugcaaaaccaaccuuccu

SEQ ID NO: 857 - RNA, 21 nt, Artificial Sequence
  source: /note="Description of Artificial Sequence: Synthetic oligonucleotide"
ccugacacacuucaaccagau

SEQ ID NO: 858 - RNA, 21 nt, Artificial Sequence
  source: /note="Description of Artificial Sequence: Synthetic oligonucleotide"
ugacacacuucaaccagaagu

SEQ ID NO: 859 - RNA, 21 nt, Artificial Sequence
  source: /note="Description of Artificial Sequence: Synthetic oligonucleotide"
gacacacuucaaccagaagcu

SEQ ID NO: 860 - RNA, 21 nt, Artificial Sequence
  source: /note="Description of Artificial Sequence: Synthetic oligonucleotide"
acacuucaaccagaagcuugu

SEQ ID NO: 861 - RNA, 21 nt, Artificial Sequence
  source: /note="Description of Artificial Sequence: Synthetic oligonucleotide"
augccuagcaagcucucaguu

SEQ ID NO: 862 - RNA, 21 nt, Artificial Sequence
  source: /note="Description of Artificial Sequence: Synthetic oligonucleotide"
ccuagcaagcucucaguaucu

SEQ ID NO: 863 - RNA, 21 nt, Artificial Sequence
  source: /note="Description of Artificial Sequence: Synthetic oligonucleotide"
cuagcaagcucucaguaucau

SEQ ID NO: 864 - RNA, 21 nt, Artificial Sequence
  source: /note="Description of Artificial Sequence: Synthetic oligonucleotide"
uagcaagcucucaguaucauu

SEQ ID NO: 865 - RNA, 21 nt, Artificial Sequence
  source: /note="Description of Artificial Sequence: Synthetic oligonucleotide"
agcaagcucucaguaucaugu

SEQ ID NO: 866 - RNA, 21 nt, Artificial Sequence
  source: /note="Description of Artificial Sequence: Synthetic oligonucleotide"
caagcucucaguaucaugcuu

SEQ ID NO: 867 - RNA, 21 nt, Artificial Sequence
  source: /note="Description of Artificial Sequence: Synthetic oligonucleotide"
cucggaagagugagguugacu

SEQ ID NO: 868 - RNA, 21 nt, Artificial Sequence
  source: /note="Description of Artificial Sequence: Synthetic oligonucleotide"
aaggagaauuguuggaaaaau

SEQ ID NO: 869 - RNA, 21 nt, Artificial Sequence
  source: /note="Description of Artificial Sequence: Synthetic oligonucleotide"
caccaaguuuggaauaagcuu

SEQ ID NO: 870 - RNA, 21 nt, Artificial Sequence
  source: /note="Description of Artificial Sequence: Synthetic oligonucleotide"
accaaguuuggaauaagcuuu

SEQ ID NO: 871 - RNA, 21 nt, Artificial Sequence
  source: /note="Description of Artificial Sequence: Synthetic oligonucleotide"
aguuccuuuucugaaucaggu

SEQ ID NO: 872 - RNA, 21 nt, Artificial Sequence
  source: /note="Description of Artificial Sequence: Synthetic oligonucleotide"
guuccuuuucugaaucaggcu

SEQ ID NO: 873 - RNA, 21 nt, Artificial Sequence
  source: /note="Description of Artificial Sequence: Synthetic oligonucleotide"
uuccuuuucugaaucaggcau

SEQ ID NO: 874 - RNA, 21 nt, Artificial Sequence
  source: /note="Description of Artificial Sequence: Synthetic oligonucleotide"
uacuucauguguacacagauu

SEQ ID NO: 875 - RNA, 21 nt, Artificial Sequence
  source: /note="Description of Artificial Sequence: Synthetic oligonucleotide"
caaggccuucauaccaaaauu

SEQ ID NO: 876 - RNA, 21 nt, Artificial Sequence
  source: /note="Description of Artificial Sequence: Synthetic oligonucleotide"
aaggccuucauaccaaaaugu

SEQ ID NO: 877 - RNA, 21 nt, Artificial Sequence
  source: /note="Description of Artificial Sequence: Synthetic oligonucleotide"
gccuucauaccaaaauggucu

SEQ ID NO: 878 - RNA, 21 nt, Artificial Sequence
  source: /note="Description of Artificial Sequence: Synthetic oligonucleotide"
caccucuaagauuuauaucau

SEQ ID NO: 879 - RNA, 21 nt, Artificial Sequence
  source: /note="Description of Artificial Sequence: Synthetic oligonucleotide"
accucuaagauuuauaucagu

SEQ ID NO: 880 - RNA, 21 nt, Artificial Sequence
  source: /note="Description of Artificial Sequence: Synthetic oligonucleotide"
gcgagacaagcacuaacacuu

SEQ ID NO: 881 - RNA, 21 nt, Artificial Sequence
  source: /note="Description of Artificial Sequence: Synthetic oligonucleotide"
cgagacaagcacuaacacugu

SEQ ID NO: 882 - RNA, 21 nt, Artificial Sequence
  source: /note="Description of Artificial Sequence: Synthetic oligonucleotide"
gagacaagcacuaacacuguu

SEQ ID NO: 883 - RNA, 21 nt, Artificial Sequence
  source: /note="Description of Artificial Sequence: Synthetic oligonucleotide"
agacaagcacuaacacugugu

SEQ ID NO: 884 - RNA, 21 nt, Artificial Sequence
  source: /note="Description of Artificial Sequence: Synthetic oligonucleotide"
cggcuugucagaccaucuugu

SEQ ID NO: 885 - RNA, 21 nt, Artificial Sequence
  source: /note="Description of Artificial Sequence: Synthetic oligonucleotide"
ggcuugucagaccaucuugau

SEQ ID NO: 886 - RNA, 21 nt, Artificial Sequence
  source: /note="Description of Artificial Sequence: Synthetic oligonucleotide"
gcuugucagaccaucuugaau

SEQ ID NO: 887 - RNA, 21 nt, Artificial Sequence
  source: /note="Description of Artificial Sequence: Synthetic oligonucleotide"
cuugucagaccaucuugaaau

SEQ ID NO: 888 - RNA, 21 nt, Artificial Sequence
  source: /note="Description of Artificial Sequence: Synthetic oligonucleotide"
uugucagaccaucuugaaaau

SEQ ID NO: 889 - RNA, 21 nt, Artificial Sequence
  source: /note="Description of Artificial Sequence: Synthetic oligonucleotide"
ugucagaccaucuugaaaagu

SEQ ID NO: 890 - RNA, 21 nt, Artificial Sequence
  source: /note="Description of Artificial Sequence: Synthetic oligonucleotide"
gucagaccaucuugaaaaggu

SEQ ID NO: 891 - RNA, 21 nt, Artificial Sequence
  source: /note="Description of Artificial Sequence: Synthetic oligonucleotide"
ucagaccaucuugaaaaggcu

SEQ ID NO: 892 - RNA, 21 nt, Artificial Sequence
  source: /note="Description of Artificial Sequence: Synthetic oligonucleotide"
acccuacaagaagaagaaucu

SEQ ID NO: 893 - RNA, 21 nt, Artificial Sequence
  source: /note="Description of Artificial Sequence: Synthetic oligonucleotide"
cugccacuggguuuuauagau

SEQ ID NO: 894 - RNA, 21 nt, Artificial Sequence
  source: /note="Description of Artificial Sequence: Synthetic oligonucleotide"
ugccacuggguuuuauagaau

SEQ ID NO: 895 - RNA, 21 nt, Artificial Sequence
  source: /note="Description of Artificial Sequence: Synthetic oligonucleotide"
cacuggguuuuauagaacacu

SEQ ID NO: 896 - RNA, 21 nt, Artificial Sequence
  source: /note="Description of Artificial Sequence: Synthetic oligonucleotide"
acuggguuuuauagaacaccu

SEQ ID NO: 897 - RNA, 21 nt, Artificial Sequence
  source: /note="Description of Artificial Sequence: Synthetic oligonucleotide"
ggguuuuauagaacacccaau

SEQ ID NO: 898 - RNA, 21 nt, Artificial Sequence
  source: /note="Description of Artificial Sequence: Synthetic oligonucleotide"
gguuuuauagaacacccaauu

SEQ ID NO: 899 - RNA, 21 nt, Artificial Sequence
  source: /note="Description of Artificial Sequence: Synthetic oligonucleotide"
ugggcuacagcuuugagacuu

SEQ ID NO: 900 - RNA, 21 nt, Artificial Sequence
  source: /note="Description of Artificial Sequence: Synthetic oligonucleotide"
gggcuacagcuuugagacuau

SEQ ID NO: 901 - RNA, 21 nt, Artificial Sequence
  source: /note="Description of Artificial Sequence: Synthetic oligonucleotide"
gcuacagcuuugagacuaacu

SEQ ID NO: 902 - RNA, 21 nt, Artificial Sequence
  source: /note="Description of Artificial Sequence: Synthetic oligonucleotide"
cuacagcuuugagacuaacuu

SEQ ID NO: 903 - RNA, 21 nt, Artificial Sequence
  source: /note="Description of Artificial Sequence: Synthetic oligonucleotide"
uacagcuuugagacuaacucu

SEQ ID NO: 904 - RNA, 21 nt, Artificial Sequence
  source: /note="Description of Artificial Sequence: Synthetic oligonucleotide"
acagcuuugagacuaacucau

SEQ ID NO: 905 - RNA, 21 nt, Artificial Sequence
  source: /note="Description of Artificial Sequence: Synthetic oligonucleotide"
cagcuuugagacuaacucagu

SEQ ID NO: 906 - RNA, 21 nt, Artificial Sequence
  source: /note="Description of Artificial Sequence: Synthetic oligonucleotide"
agcuuugagacuaacucaggu

SEQ ID NO: 907 - RNA, 21 nt, Artificial Sequence
  source: /note="Description of Artificial Sequence: Synthetic oligonucleotide"
cuuccacuacuucagcuaugu

SEQ ID NO: 908 - RNA, 21 nt, Artificial Sequence
  source: /note="Description of Artificial Sequence: Synthetic oligonucleotide"
uuccacuacuucagcuauggu

SEQ ID NO: 909 - RNA, 21 nt, Artificial Sequence
  source: /note="Description of Artificial Sequence: Synthetic oligonucleotide"
guggcuugcucugaaguagau

SEQ ID NO: 910 - RNA, 21 nt, Artificial Sequence
  source: /note="Description of Artificial Sequence: Synthetic oligonucleotide"
uggcuugcucugaaguagaau

SEQ ID NO: 911 - RNA, 21 nt, Artificial Sequence
  source: /note="Description of Artificial Sequence: Synthetic oligonucleotide"
ggcuugcucugaaguagaaau

SEQ ID NO: 912 - RNA, 21 nt, Artificial Sequence
  source: /note="Description of Artificial Sequence: Synthetic oligonucleotide"
gcuugcucugaaguagaaauu

SEQ ID NO: 913 - RNA, 21 nt, Artificial Sequence
  source: /note="Description of Artificial Sequence: Synthetic oligonucleotide"
ccuaacaggagaucauaagau

SEQ ID NO: 914 - RNA, 21 nt, Artificial Sequence
  source: /note="Description of Artificial Sequence: Synthetic oligonucleotide"
cuaacaggagaucauaagaau

SEQ ID NO: 915 - RNA, 21 nt, Artificial Sequence
  source: /note="Description of Artificial Sequence: Synthetic oligonucleotide"
uaacaggagaucauaagaacu

SEQ ID NO: 916 - RNA, 21 nt, Artificial Sequence
  source: /note="Description of Artificial Sequence: Synthetic oligonucleotide"
aacaggagaucauaagaaccu

SEQ ID NO: 917 - RNA, 21 nt, Artificial Sequence
  source: /note="Description of Artificial Sequence: Synthetic oligonucleotide"
ccuccgcacagauauugucau

SEQ ID NO: 918 - RNA, 21 nt, Artificial Sequence
  source: /note="Description of Artificial Sequence: Synthetic oligonucleotide"
cuccgcacagauauugucauu

SEQ ID NO: 919 - RNA, 21 nt, Artificial Sequence
  source: /note="Description of Artificial Sequence: Synthetic oligonucleotide"
uuggcuccagucuaaacccuu

SEQ ID NO: 920 - RNA, 21 nt, Artificial Sequence
  source: /note="Description of Artificial Sequence: Synthetic oligonucleotide"
uuccuggcugcuucuaucuuu

SEQ ID NO: 921 - RNA, 21 nt, Artificial Sequence
  source: /note="Description of Artificial Sequence: Synthetic oligonucleotide"
uccuggcugcuucuaucuucu

SEQ ID NO: 922 - RNA, 21 nt, Artificial Sequence
  source: /note="Description of Artificial Sequence: Synthetic oligonucleotide"
ccuggcugcuucuaucuucuu

SEQ ID NO: 923 - RNA, 21 nt, Artificial Sequence
  source: /note="Description of Artificial Sequence: Synthetic oligonucleotide"
cuggcugcuucuaucuucuuu

SEQ ID NO: 924 - RNA, 21 nt, Artificial Sequence
  source: /note="Description of Artificial Sequence: Synthetic oligonucleotide"
uggcugcuucuaucuucuuuu

SEQ ID NO: 925 - RNA, 21 nt, Artificial Sequence
  source: /note="Description of Artificial Sequence: Synthetic oligonucleotide"
gcugcuucuaucuucuuugcu

SEQ ID NO: 926 - RNA, 21 nt, Artificial Sequence
  source: /note="Description of Artificial Sequence: Synthetic oligonucleotide"
cugcuucuaucuucuuugccu

SEQ ID NO: 927 - RNA, 21 nt, Artificial Sequence
  source: /note="Description of Artificial Sequence: Synthetic oligonucleotide"
ugcuucuaucuucuuugccau

SEQ ID NO: 928 - RNA, 21 nt, Artificial Sequence
  source: /note="Description of Artificial Sequence: Synthetic oligonucleotide"
gcuucuaucuucuuugccauu

SEQ ID NO: 929 - RNA, 21 nt, Artificial Sequence
  source: /note="Description of Artificial Sequence: Synthetic oligonucleotide"
cuucuaucuucuuugccaucu

SEQ ID NO: 930 - RNA, 21 nt, Artificial Sequence
  source: /note="Description of Artificial Sequence: Synthetic oligonucleotide"
uucuaucuucuuugccaucau

SEQ ID NO: 931 - RNA, 21 nt, Artificial Sequence
  source: /note="Description of Artificial Sequence: Synthetic oligonucleotide"
ucuaucuucuuugccaucaau

SEQ ID NO: 932 - RNA, 21 nt, Artificial Sequence
  source: /note="Description of Artificial Sequence: Synthetic oligonucleotide"
cuaucuucuuugccaucaaau

SEQ ID NO: 933 - RNA, 21 nt, Artificial Sequence
  source: /note="Description of Artificial Sequence: Synthetic oligonucleotide"
uaucuucuuugccaucaaagu

SEQ ID NO: 934 - RNA, 21 nt, Artificial Sequence
  source: /note="Description of Artificial Sequence: Synthetic oligonucleotide"
aucuucuuugccaucaaagau

SEQ ID NO: 935 - RNA, 21 nt, Artificial Sequence
  source: /note="Description of Artificial Sequence: Synthetic oligonucleotide"
cuucuuugccaucaaagaugu

SEQ ID NO: 936 - RNA, 21 nt, Artificial Sequence
  source: /note="Description of Artificial Sequence: Synthetic oligonucleotide"
gagcucagcacacagguaauu

SEQ ID NO: 937 - RNA, 21 nt, Artificial Sequence
  source: /note="Description of Artificial Sequence: Synthetic oligonucleotide"
cucagcacacagguaauaacu

SEQ ID NO: 938 - RNA, 21 nt, Artificial Sequence
  source: /note="Description of Artificial Sequence: Synthetic oligonucleotide"
ucagcacacagguaauaacgu

SEQ ID NO: 939 - RNA, 21 nt, Artificial Sequence
  source: /note="Description of Artificial Sequence: Synthetic oligonucleotide"
cagcacacagguaauaacguu

SEQ ID NO: 940 - RNA, 21 nt, Artificial Sequence
  source: /note="Description of Artificial Sequence: Synthetic oligonucleotide"
acagguaauaacgugaaggau

SEQ ID NO: 941 - RNA, 21 nt, Artificial Sequence
  source: /note="Description of Artificial Sequence: Synthetic oligonucleotide"
cagguaauaacgugaaggaau

SEQ ID NO: 942 - RNA, 21 nt, Artificial Sequence
  source: /note="Description of Artificial Sequence: Synthetic oligonucleotide"
agguaauaacgugaaggaacu

SEQ ID NO: 943 - RNA, 21 nt, Artificial Sequence
  source: /note="Description of Artificial Sequence: Synthetic oligonucleotide"
auaacgugaaggaacucuucu

SEQ ID NO: 944 - RNA, 21 nt, Artificial Sequence
  source: /note="Description of Artificial Sequence: Synthetic oligonucleotide"
uaacgugaaggaacucuuccu

SEQ ID NO: 945 - RNA, 21 nt, Artificial Sequence
  source: /note="Description of Artificial Sequence: Synthetic oligonucleotide"
cccagaaaacugcaaacccuu

SEQ ID NO: 946 - RNA, 21 nt, Artificial Sequence
  source: /note="Description of Artificial Sequence: Synthetic oligonucleotide"
cacagaacauggaucuauuau

SEQ ID NO: 947 - RNA, 21 nt, Artificial Sequence
  source: /note="Description of Artificial Sequence: Synthetic oligonucleotide"
acagaacauggaucuauuaau

SEQ ID NO: 948 - RNA, 21 nt, Artificial Sequence
  source: /note="Description of Artificial Sequence: Synthetic oligonucleotide"
cagaacauggaucuauuaaau

SEQ ID NO: 949 - RNA, 21 nt, Artificial Sequence
  source: /note="Description of Artificial Sequence: Synthetic oligonucleotide"
agaacauggaucuauuaaagu

SEQ ID NO: 950 - RNA, 21 nt, Artificial Sequence
  source: /note="Description of Artificial Sequence: Synthetic oligonucleotide"
gaacauggaucuauuaaaguu

SEQ ID NO: 951 - RNA, 21 nt, Artificial Sequence
  source: /note="Description of Artificial Sequence: Synthetic oligonucleotide"
aacauggaucuauuaaagucu

SEQ ID NO: 952 - RNA, 21 nt, Artificial Sequence
  source: /note="Description of Artificial Sequence: Synthetic oligonucleotide"
acauggaucuauuaaagucau

SEQ ID NO: 953 - RNA, 21 nt, Artificial Sequence
  source: /note="Description of Artificial Sequence: Synthetic oligonucleotide"
cauggaucuauuaaagucacu

SEQ ID NO: 954 - RNA, 21 nt, Artificial Sequence
  source: /note="Description of Artificial Sequence: Synthetic oligonucleotide"
auggaucuauuaaagucacau

SEQ ID NO: 955 - RNA, 21 nt, Artificial Sequence
  source: /note="Description of Artificial Sequence: Synthetic oligonucleotide"
uggaucuauuaaagucacagu

SEQ ID NO: 956 - RNA, 21 nt, Artificial Sequence
  source: /note="Description of Artificial Sequence: Synthetic oligonucleotide"
ggaucuauuaaagucacagau

SEQ ID NO: 957 - RNA, 21 nt, Artificial Sequence
  source: /note="Description of Artificial Sequence: Synthetic oligonucleotide"
gaucuauuaaagucacagaau

SEQ ID NO: 958 - RNA, 21 nt, Artificial Sequence
  source: /note="Description of Artificial Sequence: Synthetic oligonucleotide"
acaaugauaagcaaauucaau

SEQ ID NO: 959 - RNA, 21 nt, Artificial Sequence
  source: /note="Description of Artificial Sequence: Synthetic oligonucleotide"
caaugauaagcaaauucaaau

SEQ ID NO: 960 - RNA, 21 nt, Artificial Sequence
  source: /note="Description of Artificial Sequence: Synthetic oligonucleotide"
augauaagcaaauucaaaacu

SEQ ID NO: 961 - RNA, 21 nt, Artificial Sequence
  source: /note="Description of Artificial Sequence: Synthetic oligonucleotide"
augccuaaauggugaauaugu

SEQ ID NO: 962 - RNA, 21 nt, Artificial Sequence
  source: /note="Description of Artificial Sequence: Synthetic oligonucleotide"
ugccuaaauggugaauaugcu

SEQ ID NO: 963 - RNA, 21 nt, Artificial Sequence
  source: /note="Description of Artificial Sequence: Synthetic oligonucleotide"
gccuaaauggugaauaugcau

SEQ ID NO: 964 - RNA, 21 nt, Artificial Sequence
  source: /note="Description of Artificial Sequence: Synthetic oligonucleotide"
ccuaaauggugaauaugcaau

SEQ ID NO: 965 - RNA, 21 nt, Artificial Sequence
  source: /note="Description of Artificial Sequence: Synthetic oligonucleotide"
cuaaauggugaauaugcaauu

SEQ ID NO: 966 - RNA, 21 nt, Artificial Sequence
  source: /note="Description of Artificial Sequence: Synthetic oligonucleotide"
aauggugaauaugcaauuagu

SEQ ID NO: 967 - RNA, 21 nt, Artificial Sequence
  source: /note="Description of Artificial Sequence: Synthetic oligonucleotide"
cgggaaggguuugugcuauuu

SEQ ID NO: 968 - RNA, 21 nt, Artificial Sequence
  source: /note="Description of Artificial Sequence: Synthetic oligonucleotide"
gggaaggguuugugcuauucu

SEQ ID NO: 969 - RNA, 21 nt, Artificial Sequence
  source: /note="Description of Artificial Sequence: Synthetic oligonucleotide"
ggaaggguuugugcuauuccu

SEQ ID NO: 970 - RNA, 21 nt, Artificial Sequence
  source: /note="Description of Artificial Sequence: Synthetic oligonucleotide"
guauaaccucaaguucugauu

SEQ ID NO: 971 - RNA, 21 nt, Artificial Sequence
  source: /note="Description of Artificial Sequence: Synthetic oligonucleotide"
uauaaccucaaguucugaugu

SEQ ID NO: 972 - RNA, 21 nt, Artificial Sequence
  source: /note="Description of Artificial Sequence: Synthetic oligonucleotide"
ccucaaguucugauggugucu

SEQ ID NO: 973 - RNA, 21 nt, Artificial Sequence
  source: /note="Description of Artificial Sequence: Synthetic oligonucleotide"
caaguucugauggugucuguu

SEQ ID NO: 974 - RNA, 21 nt, Artificial Sequence
  source: /note="Description of Artificial Sequence: Synthetic oligonucleotide"
ccacaaaccucuagaagcuuu

SEQ ID NO: 975 - RNA, 21 nt, Artificial Sequence
  source: /note="Description of Artificial Sequence: Synthetic oligonucleotide"
acaaaccucuagaagcuuaau

SEQ ID NO: 976 - RNA, 21 nt, Artificial Sequence
  source: /note="Description of Artificial Sequence: Synthetic oligonucleotide"
aaaccucuagaagcuuaaacu

SEQ ID NO: 977 - RNA, 21 nt, Artificial Sequence
  source: /note="Description of Artificial Sequence: Synthetic oligonucleotide"
aaccucuagaagcuuaaaccu

SEQ ID NO: 978 - RNA, 21 nt, Artificial Sequence
  source: /note="Description of Artificial Sequence: Synthetic oligonucleotide"
uggccuucaaaccaaugaacu

SEQ ID NO: 979 - RNA, 21 nt, Artificial Sequence
  source: /note="Description of Artificial Sequence: Synthetic oligonucleotide"
ggccuucaaaccaaugaacau

SEQ ID NO: 980 - RNA, 21 nt, Artificial Sequence
  source: /note="Description of Artificial Sequence: Synthetic oligonucleotide"
gccuucaaaccaaugaacagu

SEQ ID NO: 981 - RNA, 21 nt, Artificial Sequence
  source: /note="Description of Artificial Sequence: Synthetic oligonucleotide"
ucaaaccaaugaacagcaaau

SEQ ID NO: 982 - RNA, 21 nt, Artificial Sequence
  source: /note="Description of Artificial Sequence: Synthetic oligonucleotide"
gaacagcaaagcauaaccuuu

SEQ ID NO: 983 - RNA, 21 nt, Artificial Sequence
  source: /note="Description of Artificial Sequence: Synthetic oligonucleotide"
aacagcaaagcauaaccuugu

SEQ ID NO: 984 - RNA, 21 nt, Artificial Sequence
  source: /note="Description of Artificial Sequence: Synthetic oligonucleotide"
agcaaagcauaaccuugaauu

SEQ ID NO: 985 - RNA, 21 nt, Artificial Sequence
  source: /note="Description of Artificial Sequence: Synthetic oligonucleotide"
gcaaagcauaaccuugaaucu

SEQ ID NO: 986 - RNA, 21 nt, Artificial Sequence
  source: /note="Description of Artificial Sequence: Synthetic oligonucleotide"
caaagcauaaccuugaaucuu

SEQ ID NO: 987 - RNA, 21 nt, Artificial Sequence
  source: /note="Description of Artificial Sequence: Synthetic oligonucleotide"
gcauaaccuugaaucuauacu

SEQ ID NO: 988 - RNA, 21 nt, Artificial Sequence
  source: /note="Description of Artificial Sequence: Synthetic oligonucleotide"
cauaaccuugaaucuauacuu

SEQ ID NO: 989 - RNA, 21 nt, Artificial Sequence
  source: /note="Description of Artificial Sequence: Synthetic oligonucleotide"
auaaccuugaaucuauacucu

SEQ ID NO: 990 - RNA, 21 nt, Artificial Sequence
  source: /note="Description of Artificial Sequence: Synthetic oligonucleotide"
uaaccuugaaucuauacucau

SEQ ID NO: 991 - RNA, 21 nt, Artificial Sequence
  source: /note="Description of Artificial Sequence: Synthetic oligonucleotide"
aaccuugaaucuauacucaau

SEQ ID NO: 992 - RNA, 21 nt, Artificial Sequence
  source: /note="Description of Artificial Sequence: Synthetic oligonucleotide"
accuugaaucuauacucaaau

SEQ ID NO: 993 - RNA, 21 nt, Artificial Sequence
  source: /note="Description of Artificial Sequence: Synthetic oligonucleotide"
ccuugaaucuauacucaaauu

SEQ ID NO: 994 - RNA, 21 nt, Artificial Sequence
  source: /note="Description of Artificial Sequence: Synthetic oligonucleotide"
aaucuauacucaaauuuugcu

SEQ ID NO: 995 - RNA, 21 nt, Artificial Sequence
  source: /note="Description of Artificial Sequence: Synthetic oligonucleotide"
aucuauacucaaauuuugcau

SEQ ID NO: 996 - RNA, 21 nt, Artificial Sequence
  source: /note="Description of Artificial Sequence: Synthetic oligonucleotide"
gguuaaauccucuaaccaucu

SEQ ID NO: 997 - RNA, 21 nt, Artificial Sequence
  source: /note="Description of Artificial Sequence: Synthetic oligonucleotide"
uaaauccucuaaccaucuuuu

SEQ ID NO: 998 - RNA, 21 nt, Artificial Sequence
  source: /note="Description of Artificial Sequence: Synthetic oligonucleotide"
aaauccucuaaccaucuuugu

SEQ ID NO: 999 - RNA, 21 nt, Artificial Sequence
  source: /note="Description of Artificial Sequence: Synthetic oligonucleotide"
aauccucuaaccaucuuugau

SEQ ID NO: 1000 - RNA, 21 nt, Artificial Sequence
  source: /note="Description of Artificial Sequence: Synthetic oligonucleotide"
auccucuaaccaucuuugaau

SEQ ID NO: 1001 - RNA, 21 nt, Artificial Sequence
  source: /note="Description of Artificial Sequence: Synthetic oligonucleotide"
uccucuaaccaucuuugaauu

SEQ ID NO: 1002 - RNA, 21 nt, Artificial Sequence
  source: /note="Description of Artificial Sequence: Synthetic oligonucleotide"
ccucuaaccaucuuugaaucu

SEQ ID NO: 1003 - RNA, 21 nt, Artificial Sequence
  source: /note="Description of Artificial Sequence: Synthetic oligonucleotide"
cucuaaccaucuuugaaucau

SEQ ID NO: 1004 - RNA, 21 nt, Artificial Sequence
  source: /note="Description of Artificial Sequence: Synthetic oligonucleotide"
ucuaaccaucuuugaaucauu

SEQ ID NO: 1005 - RNA, 21 nt, Artificial Sequence
  source: /note="Description of Artificial Sequence: Synthetic oligonucleotide"
cuaaccaucuuugaaucauuu

SEQ ID NO: 1006 - RNA, 21 nt, Artificial Sequence
  source: /note="Description of Artificial Sequence: Synthetic oligonucleotide"
uaaccaucuuugaaucauugu

SEQ ID NO: 1007 - RNA, 21 nt, Artificial Sequence
  source: /note="Description of Artificial Sequence: Synthetic oligonucleotide"
aaccaucuuugaaucauuggu

SEQ ID NO: 1008 - RNA, 21 nt, Artificial Sequence
  source: /note="Description of Artificial Sequence: Synthetic oligonucleotide"
ccaucuuugaaucauuggaau

SEQ ID NO: 1009 - RNA, 21 nt, Artificial Sequence
  source: /note="Description of Artificial Sequence: Synthetic oligonucleotide"
caucuuugaaucauuggaaau

SEQ ID NO: 1010 - RNA, 21 nt, Artificial Sequence
  source: /note="Description of Artificial Sequence: Synthetic oligonucleotide"
aucuuugaaucauuggaaagu

SEQ ID NO: 1011 - RNA, 21 nt, Artificial Sequence
  source: /note="Description of Artificial Sequence: Synthetic oligonucleotide"
cuuugaaucauuggaaagaau

SEQ ID NO: 1012 - RNA, 21 nt, Artificial Sequence
  source: /note="Description of Artificial Sequence: Synthetic oligonucleotide"
gaaagaauaaagaaugaaacu

SEQ ID NO: 1013 - RNA, 21 nt, Artificial Sequence
  source: /note="Description of Artificial Sequence: Synthetic oligonucleotide"
aaagaauaaagaaugaaacau

SEQ ID NO: 1014 - RNA, 21 nt, Artificial Sequence
  source: /note="Description of Artificial Sequence: Synthetic oligonucleotide"
gaaugaaacaaauucaagguu

SEQ ID NO: 1015 - RNA, 21 nt, Artificial Sequence
  source: /note="Description of Artificial Sequence: Synthetic oligonucleotide"
augaaacaaauucaagguuau

SEQ ID NO: 1016 - RNA, 21 nt, Artificial Sequence
  source: /note="Description of Artificial Sequence: Synthetic oligonucleotide"
aacaaauucaagguuaauugu

SEQ ID NO: 1017 - RNA, 21 nt, Artificial Sequence
  source: /note="Description of Artificial Sequence: Synthetic oligonucleotide"
ugaagcugcauaaagcaagau

SEQ ID NO: 1018 - RNA, 21 nt, Artificial Sequence
  source: /note="Description of Artificial Sequence: Synthetic oligonucleotide"
aagcugcauaaagcaagauuu

SEQ ID NO: 1019 - RNA, 21 nt, Artificial Sequence
  source: /note="Description of Artificial Sequence: Synthetic oligonucleotide"
agcugcauaaagcaagauuau

SEQ ID NO: 1020 - RNA, 21 nt, Artificial Sequence
  source: /note="Description of Artificial Sequence: Synthetic oligonucleotide"
gcugcauaaagcaagauuacu

SEQ ID NO: 1021 - RNA, 21 nt, Artificial Sequence
  source: /note="Description of Artificial Sequence: Synthetic oligonucleotide"
cugcauaaagcaagauuacuu

SEQ ID NO: 1022 - RNA, 21 nt, Artificial Sequence
  source: /note="Description of Artificial Sequence: Synthetic oligonucleotide"
ugcauaaagcaagauuacucu

SEQ ID NO: 1023 - RNA, 21 nt, Artificial Sequence
  source: /note="Description of Artificial Sequence: Synthetic oligonucleotide"
cauaaagcaagauuacucuau

SEQ ID NO: 1024 - RNA, 21 nt, Artificial Sequence
  source: /note="Description of Artificial Sequence: Synthetic oligonucleotide"
uaaagcaagauuacucuauau

SEQ ID NO: 1025 - RNA, 21 nt, Artificial Sequence
  source: /note="Description of Artificial Sequence: Synthetic oligonucleotide"
auacaaaaauccaaccaacuu

SEQ ID NO: 1026 - RNA, 21 nt, Artificial Sequence
  source: /note="Description of Artificial Sequence: Synthetic oligonucleotide"
uacaaaaauccaaccaacucu

SEQ ID NO: 1027 - RNA, 21 nt, Artificial Sequence
  source: /note="Description of Artificial Sequence: Synthetic oligonucleotide"
acaaaaauccaaccaacucau

SEQ ID NO: 1028 - RNA, 21 nt, Artificial Sequence
  source: /note="Description of Artificial Sequence: Synthetic oligonucleotide"
caaaaauccaaccaacucaau

SEQ ID NO: 1029 - RNA, 21 nt, Artificial Sequence
  source: /note="Description of Artificial Sequence: Synthetic oligonucleotide"
aaaaauccaaccaacucaauu

SEQ ID NO: 1030 - RNA, 21 nt, Artificial Sequence
  source: /note="Description of Artificial Sequence: Synthetic oligonucleotide"
aaaauccaaccaacucaauuu

SEQ ID NO: 1031 - RNA, 21 nt, Artificial Sequence
  source: /note="Description of Artificial Sequence: Synthetic oligonucleotide"
aaauccaaccaacucaauuau

SEQ ID NO: 1032 - RNA, 21 nt, Artificial Sequence
  source: /note="Description of Artificial Sequence: Synthetic oligonucleotide"
aauccaaccaacucaauuauu

SEQ ID NO: 1033 - RNA, 21 nt, Artificial Sequence
  source: /note="Description of Artificial Sequence: Synthetic oligonucleotide"
auccaaccaacucaauuauuu

SEQ ID NO: 1034 - RNA, 21 nt, Artificial Sequence
  source: /note="Description of Artificial Sequence: Synthetic oligonucleotide"
uccaaccaacucaauuauugu

SEQ ID NO: 1035 - RNA, 21 nt, Artificial Sequence
  source: /note="Description of Artificial Sequence: Synthetic oligonucleotide"
ccaaccaacucaauuauugau

SEQ ID NO: 1036 - RNA, 21 nt, Artificial Sequence
  source: /note="Description of Artificial Sequence: Synthetic oligonucleotide"
caaccaacucaauuauugagu

SEQ ID NO: 1037 - RNA, 21 nt, Artificial Sequence
  source: /note="Description of Artificial Sequence: Synthetic oligonucleotide"
aaccaacucaauuauugagcu

SEQ ID NO: 1038 - RNA, 21 nt, Artificial Sequence
  source: /note="Description of Artificial Sequence: Synthetic oligonucleotide"
accaacucaauuauugagcau

SEQ ID NO: 1039 - RNA, 21 nt, Artificial Sequence
  source: /note="Description of Artificial Sequence: Synthetic oligonucleotide"
ccaacucaauuauugagcacu

SEQ ID NO: 1040 - RNA, 21 nt, Artificial Sequence
  source: /note="Description of Artificial Sequence: Synthetic oligonucleotide"
cguacaauguucuagauuucu

SEQ ID NO: 1041 - RNA, 21 nt, Artificial Sequence
  source: /note="Description of Artificial Sequence: Synthetic oligonucleotide"
guacaauguucuagauuucuu

SEQ ID NO: 1042 - RNA, 21 nt, Artificial Sequence
  source: /note="Description of Artificial Sequence: Synthetic oligonucleotide"
uacaauguucuagauuucuuu

SEQ ID NO: 1043 - RNA, 21 nt, Artificial Sequence
  source: /note="Description of Artificial Sequence: Synthetic oligonucleotide"
acaauguucuagauuucuuuu

SEQ ID NO: 1044 - RNA, 21 nt, Artificial Sequence
  source: /note="Description of Artificial Sequence: Synthetic oligonucleotide"
caauguucuagauuucuuucu

SEQ ID NO: 1045 - RNA, 21 nt, Artificial Sequence
  source: /note="Description of Artificial Sequence: Synthetic oligonucleotide"
aauguucuagauuucuuuccu

SEQ ID NO: 1046 - RNA, 21 nt, Artificial Sequence
  source: /note="Description of Artificial Sequence: Synthetic oligonucleotide"
guucuagauuucuuucccuuu

SEQ ID NO: 1047 - RNA, 21 nt, Artificial Sequence
  source: /note="Description of Artificial Sequence: Synthetic oligonucleotide"
uucuagauuucuuucccuucu

SEQ ID NO: 1048 - RNA, 21 nt, Artificial Sequence
  source: /note="Description of Artificial Sequence: Synthetic oligonucleotide"
ucuuuacauuugaagccaaau

SEQ ID NO: 1049 - RNA, 21 nt, Artificial Sequence
  source: /note="Description of Artificial Sequence: Synthetic oligonucleotide"
cuuuacauuugaagccaaagu

SEQ ID NO: 1050 - RNA, 21 nt, Artificial Sequence
  source: /note="Description of Artificial Sequence: Synthetic oligonucleotide"
uuuacauuugaagccaaaguu

SEQ ID NO: 1051 - RNA, 21 nt, Artificial Sequence
  source: /note="Description of Artificial Sequence: Synthetic oligonucleotide"
acauuugaagccaaaguaauu

SEQ ID NO: 1052 - RNA, 21 nt, Artificial Sequence
  source: /note="Description of Artificial Sequence: Synthetic oligonucleotide"
auuugaagccaaaguaauuuu

SEQ ID NO: 1053 - RNA, 21 nt, Artificial Sequence
  source: /note="Description of Artificial Sequence: Synthetic oligonucleotide"
gaagccaaaguaauuuccacu

SEQ ID NO: 1054 - RNA, 21 nt, Artificial Sequence
  source: /note="Description of Artificial Sequence: Synthetic oligonucleotide"
aagccaaaguaauuuccaccu

SEQ ID NO: 1055 - RNA, 21 nt, Artificial Sequence
  source: /note="Description of Artificial Sequence: Synthetic oligonucleotide"
ccaaaguaauuuccaccuagu

SEQ ID NO: 1056 - RNA, 21 nt, Artificial Sequence
  source: /note="Description of Artificial Sequence: Synthetic oligonucleotide"
caaaguaauuuccaccuagau

SEQ ID NO: 1057 - RNA, 21 nt, Artificial Sequence
  source: /note="Description of Artificial Sequence: Synthetic oligonucleotide"
aaaguaauuuccaccuagaau

SEQ ID NO: 1058 - RNA, 21 nt, Artificial Sequence
  source: /note="Description of Artificial Sequence: Synthetic oligonucleotide"
gcaagaucuugucucugaagu

SEQ ID NO: 1059 - RNA, 21 nt, Artificial Sequence
  source: /note="Description of Artificial Sequence: Synthetic oligonucleotide"
agguagaagagccaagaagcu

SEQ ID NO: 1060 - RNA, 21 nt, Artificial Sequence
  source: /note="Description of Artificial Sequence: Synthetic oligonucleotide"
cuagcucugucucuucugucu

SEQ ID NO: 1061 - RNA, 21 nt, Artificial Sequence
  source: /note="Description of Artificial Sequence: Synthetic oligonucleotide"
uagcucugucucuucugucuu

SEQ ID NO: 1062 - RNA, 21 nt, Artificial Sequence
  source: /note="Description of Artificial Sequence: Synthetic oligonucleotide"
agcucugucucuucugucucu

SEQ ID NO: 1063 - RNA, 21 nt, Artificial Sequence
  source: /note="Description of Artificial Sequence: Synthetic oligonucleotide"
aucuuugugaucuuggacugu

SEQ ID NO: 1064 - RNA, 21 nt, Artificial Sequence
  source: /note="Description of Artificial Sequence: Synthetic oligonucleotide"
cuuccugugauccauuuuacu

SEQ ID NO: 1065 - RNA, 21 nt, Artificial Sequence
  source: /note="Description of Artificial Sequence: Synthetic oligonucleotide"
uuccugugauccauuuuacuu

SEQ ID NO: 1066 - RNA, 21 nt, Artificial Sequence
  source: /note="Description of Artificial Sequence: Synthetic oligonucleotide"
uccugugauccauuuuacugu

SEQ ID NO: 1067 - RNA, 21 nt, Artificial Sequence
  source: /note="Description of Artificial Sequence: Synthetic oligonucleotide"
ccugugauccauuuuacugcu

SEQ ID NO: 1068 - RNA, 21 nt, Artificial Sequence
  source: /note="Description of Artificial Sequence: Synthetic oligonucleotide"
cugugauccauuuuacugcau

SEQ ID NO: 1069 - RNA, 21 nt, Artificial Sequence
  source: /note="Description of Artificial Sequence: Synthetic oligonucleotide"
cuauaaauauaugaccugaau

SEQ ID NO: 1070 - RNA, 21 nt, Artificial Sequence
  source: /note="Description of Artificial Sequence: Synthetic oligonucleotide"
ugaccugaaaacuccaguuau

SEQ ID NO: 1071 - RNA, 21 nt, Artificial Sequence
  source: /note="Description of Artificial Sequence: Synthetic oligonucleotide"
gaccugaaaacuccaguuacu

SEQ ID NO: 1072 - RNA, 21 nt, Artificial Sequence
  source: /note="Description of Artificial Sequence: Synthetic oligonucleotide"
aaggaucugcagcuaucuaau

SEQ ID NO: 1073 - RNA, 21 nt, Artificial Sequence
  source: /note="Description of Artificial Sequence: Synthetic oligonucleotide"
aggaucugcagcuaucuaagu

SEQ ID NO: 1074 - RNA, 21 nt, Artificial Sequence
  source: /note="Description of Artificial Sequence: Synthetic oligonucleotide"
gcuaucuaaggcuugguuuuu

SEQ ID NO: 1075 - RNA, 21 nt, Artificial Sequence
  source: /note="Description of Artificial Sequence: Synthetic oligonucleotide"
cuaucuaaggcuugguuuucu

SEQ ID NO: 1076 - RNA, 21 nt, Artificial Sequence
  source: /note="Description of Artificial Sequence: Synthetic oligonucleotide"
aucuaaggcuugguuuucuuu

SEQ ID NO: 1077 - RNA, 21 nt, Artificial Sequence
  source: /note="Description of Artificial Sequence: Synthetic oligonucleotide"
ucuaaggcuugguuuucuuau

SEQ ID NO: 1078 - RNA, 21 nt, Artificial Sequence
  source: /note="Description of Artificial Sequence: Synthetic oligonucleotide"
cuaaggcuugguuuucuuacu

SEQ ID NO: 1079 - RNA, 21 nt, Artificial Sequence
  source: /note="Description of Artificial Sequence: Synthetic oligonucleotide"
uaaggcuugguuuucuuacuu

SEQ ID NO: 1080 - RNA, 21 nt, Artificial Sequence
  source: /note="Description of Artificial Sequence: Synthetic oligonucleotide"
ggcuugguuuucuuacugucu

SEQ ID NO: 1081 - RNA, 21 nt, Artificial Sequence
  source: /note="Description of Artificial Sequence: Synthetic oligonucleotide"
gcuugguuuucuuacugucau

SEQ ID NO: 1082 - RNA, 21 nt, Artificial Sequence
  source: /note="Description of Artificial Sequence: Synthetic oligonucleotide"
cuugguuuucuuacugucauu

SEQ ID NO: 1083 - RNA, 21 nt, Artificial Sequence
  source: /note="Description of Artificial Sequence: Synthetic oligonucleotide"
uugguuuucuuacugucauau

SEQ ID NO: 1084 - RNA, 21 nt, Artificial Sequence
  source: /note="Description of Artificial Sequence: Synthetic oligonucleotide"
ugguuuucuuacugucauauu

SEQ ID NO: 1085 - RNA, 21 nt, Artificial Sequence
  source: /note="Description of Artificial Sequence: Synthetic oligonucleotide"
gguuuucuuacugucauaugu

SEQ ID NO: 1086 - RNA, 21 nt, Artificial Sequence
  source: /note="Description of Artificial Sequence: Synthetic oligonucleotide"
uuuucuuacugucauaugauu

SEQ ID NO: 1087 - RNA, 21 nt, Artificial Sequence
  source: /note="Description of Artificial Sequence: Synthetic oligonucleotide"
uuucuuacugucauaugauau

SEQ ID NO: 1088 - RNA, 21 nt, Artificial Sequence
  source: /note="Description of Artificial Sequence: Synthetic oligonucleotide"
ucuuacugucauaugauaccu

SEQ ID NO: 1089 - RNA, 21 nt, Artificial Sequence
  source: /note="Description of Artificial Sequence: Synthetic oligonucleotide"
cuuacugucauaugauaccuu

SEQ ID NO: 1090 - RNA, 21 nt, Artificial Sequence
  source: /note="Description of Artificial Sequence: Synthetic oligonucleotide"
ucugcgguugguaaagagaau

SEQ ID NO: 1091 - RNA, 21 nt, Artificial Sequence
  source: /note="Description of Artificial Sequence: Synthetic oligonucleotide"
uggugauuuaaucccuacauu

SEQ ID NO: 1092 - RNA, 21 nt, Artificial Sequence
  source: /note="Description of Artificial Sequence: Synthetic oligonucleotide"
ggugauuuaaucccuacaugu

SEQ ID NO: 1093 - RNA, 21 nt, Artificial Sequence
  source: /note="Description of Artificial Sequence: Synthetic oligonucleotide"
uguauaaauccaaccuucugu

SEQ ID NO: 1094 - RNA, 21 nt, Artificial Sequence
  source: /note="Description of Artificial Sequence: Synthetic oligonucleotide"
gugcuugaugucacuaauaau

SEQ ID NO: 1095 - RNA, 21 nt, Artificial Sequence
  source: /note="Description of Artificial Sequence: Synthetic oligonucleotide"
ugcuugaugucacuaauaaau

SEQ ID NO: 1096 - RNA, 21 nt, Artificial Sequence
  source: /note="Description of Artificial Sequence: Synthetic oligonucleotide"
gcuugaugucacuaauaaauu

SEQ ID NO: 1097 - RNA, 21 nt, Artificial Sequence
  source: /note="Description of Artificial Sequence: Synthetic oligonucleotide"
augucacuaauaaaugaaacu

SEQ ID NO: 1098 - RNA, 21 nt, Artificial Sequence
  source: /note="Description of Artificial Sequence: Synthetic oligonucleotide"
ugucacuaauaaaugaaacuu

SEQ ID NO: 1099 - RNA, 21 nt, Artificial Sequence
  source: /note="Description of Artificial Sequence: Synthetic oligonucleotide"
uaauaaaugaaacugucagcu

SEQ ID NO: 1100 - RNA, 23 nt, Artificial Sequence
  source: /note="Description of Artificial Sequence: Synthetic oligonucleotide"
acuaagagacacuggcagguagu

SEQ ID NO: 1101 - RNA, 23 nt, Artificial Sequence
  source: /note="Description of Artificial Sequence: Synthetic oligonucleotide"
accuaagagacacuggcagguag

SEQ ID NO: 1102 - RNA, 23 nt, Artificial Sequence
  source: /note="Description of Artificial Sequence: Synthetic oligonucleotide"
auccuaagagacacuggcaggua

SEQ ID NO: 1103 - RNA, 23 nt, Artificial Sequence
  source: /note="Description of Artificial Sequence: Synthetic oligonucleotide"
aacuccuaagagacacuggcagg

SEQ ID NO: 1104 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acactccuaagagacacuggcag

SEQ ID NO: 1105 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucacuccuaagagacacuggca

SEQ ID NO: 1106 - RNA, 23 nt, Artificial Sequence
  source: /note="Description of Artificial Sequence: Synthetic oligonucleotide"
acucacuccuaagagacacuggc

SEQ ID NO: 1107 - RNA, 23 nt, Artificial Sequence
  source: /note="Description of Artificial Sequence: Synthetic oligonucleotide"
accucacuccuaagagacacugg

SEQ ID NO: 1108 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggaucugcauuuuucuccacc

SEQ ID NO: 1109 - RNA, 23 nt, Artificial Sequence
  source: /note="Description of Artificial Sequence: Synthetic oligonucleotide"
agccaaaaggguugucucuggau

SEQ ID NO: 1110 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggccaaaaggguugucucugg

SEQ ID NO: 1111 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuuggagagcaucacugugcaa

SEQ ID NO: 1112 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacutggagagcaucacugugca

SEQ ID NO: 1113 - RNA, 23 nt, Artificial Sequence
  source: /note="Description of Artificial Sequence: Synthetic oligonucleotide"
agaucauacuuggagagcaucac

SEQ ID NO: 1114 - RNA, 23 nt, Artificial Sequence
  source: /note="Description of Artificial Sequence: Synthetic oligonucleotide"
acgaucauacuuggagagcauca

SEQ ID NO: 1115 - RNA, 23 nt, Artificial Sequence
  source: /note="Description of Artificial Sequence: Synthetic oligonucleotide"
aacgaucauacuuggagagcauc

SEQ ID NO: 1116 - RNA, 23 nt, Artificial Sequence
  source: /note="Description of Artificial Sequence: Synthetic oligonucleotide"
agacgaucauacuuggagagcau

SEQ ID NO: 1117 - RNA, 23 nt, Artificial Sequence
  source: /note="Description of Artificial Sequence: Synthetic oligonucleotide"
aagacgaucauacuuggagagca

SEQ ID NO: 1118 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctuguucugcagacgaucau

SEQ ID NO: 1119 - RNA, 23 nt, Artificial Sequence
  source: /note="Description of Artificial Sequence: Synthetic oligonucleotide"
aacgaucuuguucugcagacgau

SEQ ID NO: 1120 - RNA, 23 nt, Artificial Sequence
  source: /note="Description of Artificial Sequence: Synthetic oligonucleotide"
agacgaucuuguucugcagacga

SEQ ID NO: 1121 - RNA, 23 nt, Artificial Sequence
  source: /note="Description of Artificial Sequence: Synthetic oligonucleotide"
aggacgaucuuguucugcagacg

SEQ ID NO: 1122 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaguggacgaucuuguucugcag

SEQ ID NO: 1123 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagtggacgaucuuguucugca

SEQ ID NO: 1124 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaagtggacgaucuuguucug

SEQ ID NO: 1125 - RNA, 23 nt, Artificial Sequence
  source: /note="Description of Artificial Sequence: Synthetic oligonucleotide"
agaaaaguggacgaucuuguucu

SEQ ID NO: 1126 - RNA, 23 nt, Artificial Sequence
  source: /note="Description of Artificial Sequence: Synthetic oligonucleotide"
aagaaaaguggacgaucuuguuc

SEQ ID NO: 1127 - RNA, 23 nt, Artificial Sequence
  source: /note="Description of Artificial Sequence: Synthetic oligonucleotide"
acagaaaaguggacgaucuuguu

SEQ ID NO: 1128 - RNA, 23 nt, Artificial Sequence
  source: /note="Description of Artificial Sequence: Synthetic oligonucleotide"
agcagaaaaguggacgaucuugu

SEQ ID NO: 1129 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acautggcagaaaaguggacgau

SEQ ID NO: 1130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatuggcagaaaaguggacga

SEQ ID NO: 1131 - RNA, 23 nt, Artificial Sequence
  source: /note="Description of Artificial Sequence: Synthetic oligonucleotide"
agcaacauggugcaaggagcaga

SEQ ID NO: 1132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugcaacauggugcaaggagc

SEQ ID NO: 1133 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucactgcaacauggugcaagg

SEQ ID NO: 1134 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguugucacugcaacauggugca

SEQ ID NO: 1135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutgtcacugcaacauggugc

SEQ ID NO: 1136 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcututggcaauucucuccugc

SEQ ID NO: 1137 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggctutuggcaauucucuccug

SEQ ID NO: 1138 - RNA, 23 nt, Artificial Sequence
  source: /note="Description of Artificial Sequence: Synthetic oligonucleotide"
aacauacucaugacgaugccagg

SEQ ID NO: 1139 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auacauacucaugacgaugccag

SEQ ID NO: 1140 - RNA, 23 nt, Artificial Sequence
  source: /note="Description of Artificial Sequence: Synthetic oligonucleotide"
aguacauacucaugacgaugcca

SEQ ID NO: 1141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguacauacucaugacgaugcc

SEQ ID NO: 1142 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtacauacucaugacgaugc

SEQ ID NO: 1143 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtgtacauacucaugacgau

SEQ ID NO: 1144 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaguguguacauacucaugacga

SEQ ID NO: 1145 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgtguacauacucaugacg

SEQ ID NO: 1146 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatutccuuggaaggcauucu

SEQ ID NO: 1147 - RNA, 23 nt, Artificial Sequence
  source: /note="Description of Artificial Sequence: Synthetic oligonucleotide"
acagauuuccuuggaaggcauuc

SEQ ID NO: 1148 - RNA, 23 nt, Artificial Sequence
  source: /note="Description of Artificial Sequence: Synthetic oligonucleotide"
aacagauuuccuuggaaggcauu

SEQ ID NO: 1149 - RNA, 23 nt, Artificial Sequence
  source: /note="Description of Artificial Sequence: Synthetic oligonucleotide"
acacagauuuccuuggaaggcau

SEQ ID NO: 1150 - RNA, 23 nt, Artificial Sequence
  source: /note="Description of Artificial Sequence: Synthetic oligonucleotide"
agcacagauuuccuuggaaggca

SEQ ID NO: 1151 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatucuugaacuucaucucaa

SEQ ID NO: 1152 - RNA, 23 nt, Artificial Sequence
  source: /note="Description of Artificial Sequence: Synthetic oligonucleotide"
agcauauucuugaacuucaucuc

SEQ ID NO: 1153 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacagcauauucuugaacuuca

SEQ ID NO: 1154 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaacagcauauucuugaacuuc

SEQ ID NO: 1155 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaacagcauauucuugaacuu

SEQ ID NO: 1156 - RNA, 23 nt, Artificial Sequence
  source: /note="Description of Artificial Sequence: Synthetic oligonucleotide"
aggaaacagcauauucuugaacu

SEQ ID NO: 1157 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaggaaacagcauauucuuga

SEQ ID NO: 1158 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatgcugagaaauacuccccc

SEQ ID NO: 1159 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaaugcugagaaauacucccc

SEQ ID NO: 1160 - RNA, 23 nt, Artificial Sequence
  source: /note="Description of Artificial Sequence: Synthetic oligonucleotide"
auugaaugcugagaaauacuccc

SEQ ID NO: 1161 - RNA, 23 nt, Artificial Sequence
  source: /note="Description of Artificial Sequence: Synthetic oligonucleotide"
acuugaaugcugagaaauacucc

SEQ ID NO: 1162 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutgaaugcugagaaauacuc

SEQ ID NO: 1163 - RNA, 23 nt, Artificial Sequence
  source: /note="Description of Artificial Sequence: Synthetic oligonucleotide"
agaauaaaacucucaugccacug

SEQ ID NO: 1164 - RNA, 23 nt, Artificial Sequence
  source: /note="Description of Artificial Sequence: Synthetic oligonucleotide"
auugaauaaaacucucaugccac

SEQ ID NO: 1165 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutgaauaaaacucucaugcc

SEQ ID NO: 1166 - RNA, 23 nt, Artificial Sequence
  source: /note="Description of Artificial Sequence: Synthetic oligonucleotide"
aagaagaagcugagggugagggu

SEQ ID NO: 1167 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagaagaagcugagggugagg

SEQ ID NO: 1168 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augucagguagaacuugaagaag

SEQ ID NO: 1169 - RNA, 23 nt, Artificial Sequence
  source: /note="Description of Artificial Sequence: Synthetic oligonucleotide"
aguaaaguugcacuggcgaaagu

SEQ ID NO: 1170 - RNA, 23 nt, Artificial Sequence
  source: /note="Description of Artificial Sequence: Synthetic oligonucleotide"
aaguaaaguugcacuggcgaaag

SEQ ID NO: 1171 - RNA, 23 nt, Artificial Sequence
  source: /note="Description of Artificial Sequence: Synthetic oligonucleotide"
agaaacaaacaaacccuggaacc

SEQ ID NO: 1172 - RNA, 23 nt, Artificial Sequence
  source: /note="Description of Artificial Sequence: Synthetic oligonucleotide"
aaaugaaacaaacaaacccugga

SEQ ID NO: 1173 - RNA, 23 nt, Artificial Sequence
  source: /note="Description of Artificial Sequence: Synthetic oligonucleotide"
agaaaugaaacaaacaaacccug

SEQ ID NO: 1174 - RNA, 23 nt, Artificial Sequence
  source: /note="Description of Artificial Sequence: Synthetic oligonucleotide"
aggaaaugaaacaaacaaacccu

SEQ ID NO: 1175 - RNA, 23 nt, Artificial Sequence
  source: /note="Description of Artificial Sequence: Synthetic oligonucleotide"
aagcggaaaugaaacaaacaaac

SEQ ID NO: 1176 - RNA, 23 nt, Artificial Sequence
  source: /note="Description of Artificial Sequence: Synthetic oligonucleotide"
aaguuauguuacucccaggaaca

SEQ ID NO: 1177 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuccaguuauguuacucccag

SEQ ID NO: 1178 - RNA, 23 nt, Artificial Sequence
  source: /note="Description of Artificial Sequence: Synthetic oligonucleotide"
auacaaauuccaguuauguuacu

SEQ ID NO: 1179 - RNA, 23 nt, Artificial Sequence
  source: /note="Description of Artificial Sequence: Synthetic oligonucleotide"
auuacaaauuccaguuauguuac

SEQ ID NO: 1180 - RNA, 23 nt, Artificial Sequence
  source: /note="Description of Artificial Sequence: Synthetic oligonucleotide"
aacaaguaaccuuauccuucgca

SEQ ID NO: 1181 - RNA, 23 nt, Artificial Sequence
  source: /note="Description of Artificial Sequence: Synthetic oligonucleotide"
acacaaguaaccuuauccuucgc

SEQ ID NO: 1182 - RNA, 23 nt, Artificial Sequence
  source: /note="Description of Artificial Sequence: Synthetic oligonucleotide"
auucauaggugauuuucaccccu

SEQ ID NO: 1183 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguagutcuucauaggugauuuu

SEQ ID NO: 1184 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguagtucuucauaggugauuu

SEQ ID NO: 1185 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgtgauaauggcugguagu

SEQ ID NO: 1186 - RNA, 23 nt, Artificial Sequence
  source: /note="Description of Artificial Sequence: Synthetic oligonucleotide"
aguccauaaaaggaguuguucuu

SEQ ID NO: 1187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggtagaagugcucuuggccac

SEQ ID NO: 1188 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctccagguagaagugcucuu

SEQ ID NO: 1189 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtctccagguagaagugcuc

SEQ ID NO: 1190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagucuccagguagaagugcu

SEQ ID NO: 1191 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaacagcaauggugcagugagu

SEQ ID NO: 1192 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaacagcaauggugcagugag

SEQ ID NO: 1193 - RNA, 23 nt, Artificial Sequence
  source: /note="Description of Artificial Sequence: Synthetic oligonucleotide"
agccuuuuggaacagcaauggug

SEQ ID NO: 1194 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgtagacacaaagagcucc

SEQ ID NO: 1195 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuguguagacacaaagagcuc

SEQ ID NO: 1196 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgtguagacacaaagagcu

SEQ ID NO: 1197 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguucuguguagacacaaagagc

SEQ ID NO: 1198 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutctguguagacacaaagag

SEQ ID NO: 1199 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtucuguguagacacaaaga

SEQ ID NO: 1200 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguctucaugguguucuguguag

SEQ ID NO: 1201 - RNA, 23 nt, Artificial Sequence
  source: /note="Description of Artificial Sequence: Synthetic oligonucleotide"
aacauuuuugcaacaaagcucug

SEQ ID NO: 1202 - RNA, 23 nt, Artificial Sequence
  source: /note="Description of Artificial Sequence: Synthetic oligonucleotide"
aaacauuuuugcaacaaagcucu

SEQ ID NO: 1203 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauactcugagagagauccugg

SEQ ID NO: 1204 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatacucugagagagauccug

SEQ ID NO: 1205 - RNA, 23 nt, Artificial Sequence
  source: /note="Description of Artificial Sequence: Synthetic oligonucleotide"
aauaauacucugagagagauccu

SEQ ID NO: 1206 - RNA, 23 nt, Artificial Sequence
  source: /note="Description of Artificial Sequence: Synthetic oligonucleotide"
acauaauacucugagagagaucc

SEQ ID NO: 1207 - RNA, 23 nt, Artificial Sequence
  source: /note="Description of Artificial Sequence: Synthetic oligonucleotide"
accauaauacucugagagagauc

SEQ ID NO: 1208 - RNA, 23 nt, Artificial Sequence
  source: /note="Description of Artificial Sequence: Synthetic oligonucleotide"
auccauaauacucugagagagau

SEQ ID NO: 1209 - RNA, 23 nt, Artificial Sequence
  source: /note="Description of Artificial Sequence: Synthetic oligonucleotide"
auuccauaauacucugagagaga

SEQ ID NO: 1210 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuccauaauacucugagagag

SEQ ID NO: 1211 - RNA, 23 nt, Artificial Sequence
  source: /note="Description of Artificial Sequence: Synthetic oligonucleotide"
acguuccauaauacucugagaga

SEQ ID NO: 1212 - RNA, 23 nt, Artificial Sequence
  source: /note="Description of Artificial Sequence: Synthetic oligonucleotide"
acucguuccauaauacucugaga

SEQ ID NO: 1213 - RNA, 23 nt, Artificial Sequence
  source: /note="Description of Artificial Sequence: Synthetic oligonucleotide"
agcucguuccauaauacucugag

SEQ ID NO: 1214 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaggtugguuuugcacagccg

SEQ ID NO: 1215 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaagguugguuuugcacagcc

SEQ ID NO: 1216 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuggtugaagugugucagguc

SEQ ID NO: 1217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucugguugaagugugucagg

SEQ ID NO: 1218 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutctgguugaagugugucag

SEQ ID NO: 1219 - RNA, 23 nt, Artificial Sequence
  source: /note="Description of Artificial Sequence: Synthetic oligonucleotide"
acaagcuucugguugaagugugu

SEQ ID NO: 1220 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugagagcuugcuaggcauuc

SEQ ID NO: 1221 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauactgagagcuugcuaggca

SEQ ID NO: 1222 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatacugagagcuugcuaggc

SEQ ID NO: 1223 - RNA, 23 nt, Artificial Sequence
  source: /note="Description of Artificial Sequence: Synthetic oligonucleotide"
aaugauacugagagcuugcuagg

SEQ ID NO: 1224 - RNA, 23 nt, Artificial Sequence
  source: /note="Description of Artificial Sequence: Synthetic oligonucleotide"
acaugauacugagagcuugcuag

SEQ ID NO: 1225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcaugauacugagagcuugcu

SEQ ID NO: 1226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agucaaccucacucuuccgagca

SEQ ID NO: 1227 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutuccaacaauucuccuugu

SEQ ID NO: 1228 - RNA, 23 nt, Artificial Sequence
  source: /note="Description of Artificial Sequence: Synthetic oligonucleotide"
aagcuuauuccaaacuugguggg

SEQ ID NO: 1229 - RNA, 23 nt, Artificial Sequence
  source: /note="Description of Artificial Sequence: Synthetic oligonucleotide"
aaagcuuauuccaaacuuggugg

SEQ ID NO: 1230 - RNA, 23 nt, Artificial Sequence
  source: /note="Description of Artificial Sequence: Synthetic oligonucleotide"
accugauucagaaaaggaacugu

SEQ ID NO: 1231 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctgauucagaaaaggaacug

SEQ ID NO: 1232 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augccugauucagaaaaggaacu

SEQ ID NO: 1233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauctgtguacacaugaaguagg

SEQ ID NO: 1234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutugguaugaaggccuuggc

SEQ ID NO: 1235 - RNA, 23 nt, Artificial Sequence
  source: /note="Description of Artificial Sequence: Synthetic oligonucleotide"
acauuuugguaugaaggccuugg

SEQ ID NO: 1236 - RNA, 23 nt, Artificial Sequence
  source: /note="Description of Artificial Sequence: Synthetic oligonucleotide"
agaccauuuugguaugaaggccu

SEQ ID NO: 1237 - RNA, 23 nt, Artificial Sequence
  source: /note="Description of Artificial Sequence: Synthetic oligonucleotide"
augauauaaaucuuagagguggg

SEQ ID NO: 1238 - RNA, 23 nt, Artificial Sequence
  source: /note="Description of Artificial Sequence: Synthetic oligonucleotide"
acugauauaaaucuuagaggugg

SEQ ID NO: 1239 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagugutagugcuugucucgcug

SEQ ID NO: 1240 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acagtgtuagugcuugucucgcu

SEQ ID NO: 1241 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaguguuagugcuugucucgc

SEQ ID NO: 1242 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acacagtguuagugcuugucucg

SEQ ID NO: 1243 - RNA, 23 nt, Artificial Sequence
  source: /note="Description of Artificial Sequence: Synthetic oligonucleotide"
acaagauggucugacaagccgca

SEQ ID NO: 1244 - RNA, 23 nt, Artificial Sequence
  source: /note="Description of Artificial Sequence: Synthetic oligonucleotide"
aucaagauggucugacaagccgc

SEQ ID NO: 1245 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auucaagauggucugacaagccg

SEQ ID NO: 1246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuucaagauggucugacaagcc

SEQ ID NO: 1247 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuutcaagauggucugacaagc

SEQ ID NO: 1248 - RNA, 23 nt, Artificial Sequence
  source: /note="Description of Artificial Sequence: Synthetic oligonucleotide"
acuuuucaagauggucugacaag

SEQ ID NO: 1249 - RNA, 23 nt, Artificial Sequence
  source: /note="Description of Artificial Sequence: Synthetic oligonucleotide"
accuuuucaagauggucugacaa

SEQ ID NO: 1250 - RNA, 23 nt, Artificial Sequence
  source: /note="Description of Artificial Sequence: Synthetic oligonucleotide"
agccuuuucaagauggucugaca

SEQ ID NO: 1251 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautctucuucuuguaggguuc

SEQ ID NO: 1252 - RNA, 23 nt, Artificial Sequence
  source: /note="Description of Artificial Sequence: Synthetic oligonucleotide"
aucuauaaaacccaguggcagac

SEQ ID NO: 1253 - RNA, 23 nt, Artificial Sequence
  source: /note="Description of Artificial Sequence: Synthetic oligonucleotide"
auucuauaaaacccaguggcaga

SEQ ID NO: 1254 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtucuauaaaacccaguggc

SEQ ID NO: 1255 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggugutcuauaaaacccagugg

SEQ ID NO: 1256 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugggtguucuauaaaacccag

SEQ ID NO: 1257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuggguguucuauaaaaccca

SEQ ID NO: 1258 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagucucaaagcuguagcccaga

SEQ ID NO: 1259 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagtctcaaagcuguagcccag

SEQ ID NO: 1260 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuagtcucaaagcuguagccc

SEQ ID NO: 1261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutagucucaaagcuguagcc

SEQ ID NO: 1262 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtuagucucaaagcuguagc

SEQ ID NO: 1263 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagutagucucaaagcuguag

SEQ ID NO: 1264 - RNA, 23 nt, Artificial Sequence
  source: /note="Description of Artificial Sequence: Synthetic oligonucleotide"
acugaguuagucucaaagcugua

SEQ ID NO: 1265 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugaguuagucucaaagcugu

SEQ ID NO: 1266 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauagcugaaguaguggaaggg

SEQ ID NO: 1267 - RNA, 23 nt, Artificial Sequence
  source: /note="Description of Artificial Sequence: Synthetic oligonucleotide"
accauagcugaaguaguggaagg

SEQ ID NO: 1268 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuactucagagcaagccaccc

SEQ ID NO: 1269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctacuucagagcaagccacc

SEQ ID NO: 1270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuucuacuucagagcaagccac

SEQ ID NO: 1271 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutctacuucagagcaagcca

SEQ ID NO: 1272 - RNA, 23 nt, Artificial Sequence
  source: /note="Description of Artificial Sequence: Synthetic oligonucleotide"
aucuuaugaucuccuguuaggca

SEQ ID NO: 1273 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctuaugaucuccuguuaggc

SEQ ID NO: 1274 - RNA, 23 nt, Artificial Sequence
  source: /note="Description of Artificial Sequence: Synthetic oligonucleotide"
aguucuuaugaucuccuguuagg

SEQ ID NO: 1275 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutctuaugaucuccuguuag

SEQ ID NO: 1276 - RNA, 23 nt, Artificial Sequence
  source: /note="Description of Artificial Sequence: Synthetic oligonucleotide"
augacaauaucugugcggagguu

SEQ ID NO: 1277 - RNA, 23 nt, Artificial Sequence
  source: /note="Description of Artificial Sequence: Synthetic oligonucleotide"
aaugacaauaucugugcggaggu

SEQ ID NO: 1278 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagggutuagacuggagccaaca

SEQ ID NO: 1279 - RNA, 23 nt, Artificial Sequence
  source: /note="Description of Artificial Sequence: Synthetic oligonucleotide"
aaagauagaagcagccaggaaga

SEQ ID NO: 1280 - RNA, 23 nt, Artificial Sequence
  source: /note="Description of Artificial Sequence: Synthetic oligonucleotide"
agaagauagaagcagccaggaag

SEQ ID NO: 1281 - RNA, 23 nt, Artificial Sequence
  source: /note="Description of Artificial Sequence: Synthetic oligonucleotide"
aagaagauagaagcagccaggaa

SEQ ID NO: 1282 - RNA, 23 nt, Artificial Sequence
  source: /note="Description of Artificial Sequence: Synthetic oligonucleotide"
aaagaagauagaagcagccagga

SEQ ID NO: 1283 - RNA, 23 nt, Artificial Sequence
  source: /note="Description of Artificial Sequence: Synthetic oligonucleotide"
aaaagaagauagaagcagccagg

SEQ ID NO: 1284 - RNA, 23 nt, Artificial Sequence
  source: /note="Description of Artificial Sequence: Synthetic oligonucleotide"
agcaaagaagauagaagcagcca

SEQ ID NO: 1285 - RNA, 23 nt, Artificial Sequence
  source: /note="Description of Artificial Sequence: Synthetic oligonucleotide"
aggcaaagaagauagaagcagcc

SEQ ID NO: 1286 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggcaaagaagauagaagcagc

SEQ ID NO: 1287 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauggcaaagaagauagaagcag

SEQ ID NO: 1288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauggcaaagaagauagaagca

SEQ ID NO: 1289 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatggcaaagaagauagaagc

SEQ ID NO: 1290 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugauggcaaagaagauagaag

SEQ ID NO: 1291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugatggcaaagaagauagaa

SEQ ID NO: 1292 - RNA, 23 nt, Artificial Sequence
  source: /note="Description of Artificial Sequence: Synthetic oligonucleotide"
acuuugauggcaaagaagauaga

SEQ ID NO: 1293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutugauggcaaagaagauag

SEQ ID NO: 1294 - RNA, 23 nt, Artificial Sequence
  source: /note="Description of Artificial Sequence: Synthetic oligonucleotide"
acaucuuugauggcaaagaagau

SEQ ID NO: 1295 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuaccugugugcugagcucga

SEQ ID NO: 1296 - RNA, 23 nt, Artificial Sequence
  source: /note="Description of Artificial Sequence: Synthetic oligonucleotide"
aguuauuaccugugugcugagcu

SEQ ID NO: 1297 - RNA, 23 nt, Artificial Sequence
  source: /note="Description of Artificial Sequence: Synthetic oligonucleotide"
acguuauuaccugugugcugagc

SEQ ID NO: 1298 - RNA, 23 nt, Artificial Sequence
  source: /note="Description of Artificial Sequence: Synthetic oligonucleotide"
aacguuauuaccugugugcugag

SEQ ID NO: 1299 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucctucacguuauuaccugugu

SEQ ID NO: 1300 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuccutcacguuauuaccugug

SEQ ID NO: 1301 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguucctucacguuauuaccugu

SEQ ID NO: 1302 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagaguuccuucacguuauua

SEQ ID NO: 1303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaagaguuccuucacguuauu

SEQ ID NO: 1304 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagggutugcaguuuucugggac

SEQ ID NO: 1305 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatagauccauguucuguggu

SEQ ID NO: 1306 - RNA, 23 nt, Artificial Sequence
  source: /note="Description of Artificial Sequence: Synthetic oligonucleotide"
auuaauagauccauguucugugg

SEQ ID NO: 1307 - RNA, 23 nt, Artificial Sequence
  source: /note="Description of Artificial Sequence: Synthetic oligonucleotide"
auuuaauagauccauguucugug

SEQ ID NO: 1308 - RNA, 23 nt, Artificial Sequence
  source: /note="Description of Artificial Sequence: Synthetic oligonucleotide"
acuuuaauagauccauguucugu

SEQ ID NO: 1309 - RNA, 23 nt, Artificial Sequence
  source: /note="Description of Artificial Sequence: Synthetic oligonucleotide"
aacuuuaauagauccauguucug

SEQ ID NO: 1310 - RNA, 23 nt, Artificial Sequence
  source: /note="Description of Artificial Sequence: Synthetic oligonucleotide"
agacuuuaauagauccauguucu

SEQ ID NO: 1311 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augacutuaauagauccauguuc

SEQ ID NO: 1312 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugactuuaauagauccauguu

SEQ ID NO: 1313 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augugacuuuaauagauccaugu

SEQ ID NO: 1314 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugtgacuuuaauagauccaug

SEQ ID NO: 1315 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucugugacuuuaauagauccau

SEQ ID NO: 1316 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgtgacuuuaauagaucca

SEQ ID NO: 1317 - RNA, 23 nt, Artificial Sequence
  source: /note="Description of Artificial Sequence: Synthetic oligonucleotide"
auugaauuugcuuaucauugugu

SEQ ID NO: 1318 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugaauuugcuuaucauugug

SEQ ID NO: 1319 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutugaauuugcuuaucauug

SEQ ID NO: 1320 - RNA, 23 nt, Artificial Sequence
  source: /note="Description of Artificial Sequence: Synthetic oligonucleotide"
acauauucaccauuuaggcauaa

SEQ ID NO: 1321 - RNA, 23 nt, Artificial Sequence
  source: /note="Description of Artificial Sequence: Synthetic oligonucleotide"
agcauauucaccauuuaggcaua

SEQ ID NO: 1322 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcauauucaccauuuaggcau

SEQ ID NO: 1323 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugcatauucaccauuuaggca

SEQ ID NO: 1324 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugcauauucaccauuuaggc

SEQ ID NO: 1325 - RNA, 23 nt, Artificial Sequence
  source: /note="Description of Artificial Sequence: Synthetic oligonucleotide"
acuaauugcauauucaccauuua

SEQ ID NO: 1326 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauagcacaaacccuucccgac

SEQ ID NO: 1327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaatagcacaaacccuucccga

SEQ ID NO: 1328 - RNA, 23 nt, Artificial Sequence
  source: /note="Description of Artificial Sequence: Synthetic oligonucleotide"
aggaauagcacaaacccuucccg

SEQ ID NO: 1329 - RNA, 23 nt, Artificial Sequence
  source: /note="Description of Artificial Sequence: Synthetic oligonucleotide"
aaucagaacuugagguuauacag

SEQ ID NO: 1330 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaucagaacuugagguuauaca

SEQ ID NO: 1331 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacaccaucagaacuugagguu

SEQ ID NO: 1332 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacagacaccaucagaacuugag

SEQ ID NO: 1333 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcutcuagagguuuguggga

SEQ ID NO: 1334 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuaagcuucuagagguuugugg

SEQ ID NO: 1335 - RNA, 23 nt, Artificial Sequence
  source: /note="Description of Artificial Sequence: Synthetic oligonucleotide"
aguuuaagcuucuagagguuugu

SEQ ID NO: 1336 - RNA, 23 nt, Artificial Sequence
  source: /note="Description of Artificial Sequence: Synthetic oligonucleotide"
agguuuaagcuucuagagguuug

SEQ ID NO: 1337 - RNA, 23 nt, Artificial Sequence
  source: /note="Description of Artificial Sequence: Synthetic oligonucleotide"
aguucauugguuugaaggccagg

SEQ ID NO: 1338 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutcauugguuugaaggccag

SEQ ID NO: 1339 - RNA, 23 nt, Artificial Sequence
  source: /note="Description of Artificial Sequence: Synthetic oligonucleotide"
acuguucauugguuugaaggcca

SEQ ID NO: 1340 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugctguucauugguuugaag

SEQ ID NO: 1341 - RNA, 23 nt, Artificial Sequence
  source: /note="Description of Artificial Sequence: Synthetic oligonucleotide"
aaagguuaugcuuugcuguucau

SEQ ID NO: 1342 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaaggtuaugcuuugcuguuca

SEQ ID NO: 1343 - RNA, 23 nt, Artificial Sequence
  source: /note="Description of Artificial Sequence: Synthetic oligonucleotide"
aauucaagguuaugcuuugcugu

SEQ ID NO: 1344 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautcaagguuaugcuuugcug

SEQ ID NO: 1345 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagatucaagguuaugcuuugcu

SEQ ID NO: 1346 - RNA, 23 nt, Artificial Sequence
  source: /note="Description of Artificial Sequence: Synthetic oligonucleotide"
aguauagauucaagguuaugcuu

SEQ ID NO: 1347 - RNA, 23 nt, Artificial Sequence
  source: /note="Description of Artificial Sequence: Synthetic oligonucleotide"
aaguauagauucaagguuaugcu

SEQ ID NO: 1348 - RNA, 23 nt, Artificial Sequence
  source: /note="Description of Artificial Sequence: Synthetic oligonucleotide"
agaguauagauucaagguuaugc

SEQ ID NO: 1349 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaguauagauucaagguuaug

SEQ ID NO: 1350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugagtauagauucaagguuau

SEQ ID NO: 1351 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuugaguauagauucaagguua

SEQ ID NO: 1352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauutgaguauagauucaagguu

SEQ ID NO: 1353 - RNA, 23 nt, Artificial Sequence
  source: /note="Description of Artificial Sequence: Synthetic oligonucleotide"
agcaaaauuugaguauagauuca

SEQ ID NO: 1354 - RNA, 23 nt, Artificial Sequence
  source: /note="Description of Artificial Sequence: Synthetic oligonucleotide"
augcaaaauuugaguauagauuc

SEQ ID NO: 1355 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauggtuagaggauuuaaccuu

SEQ ID NO: 1356 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagatgguuagaggauuuaac

SEQ ID NO: 1357 - RNA, 23 nt, Artificial Sequence
  source: /note="Description of Artificial Sequence: Synthetic oligonucleotide"
acaaagaugguuagaggauuuaa

SEQ ID NO: 1358 - RNA, 23 nt, Artificial Sequence
  source: /note="Description of Artificial Sequence: Synthetic oligonucleotide"
aucaaagaugguuagaggauuua

SEQ ID NO: 1359 - RNA, 23 nt, Artificial Sequence
  source: /note="Description of Artificial Sequence: Synthetic oligonucleotide"
auucaaagaugguuagaggauuu

SEQ ID NO: 1360 - RNA, 23 nt, Artificial Sequence
  source: /note="Description of Artificial Sequence: Synthetic oligonucleotide"
aauucaaagaugguuagaggauu

SEQ ID NO: 1361 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agautcaaagaugguuagaggau

SEQ ID NO: 1362 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augatucaaagaugguuagagga

SEQ ID NO: 1363 - RNA, 23 nt, Artificial Sequence
  source: /note="Description of Artificial Sequence: Synthetic oligonucleotide"
aaugauucaaagaugguuagagg

SEQ ID NO: 1364 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaugatucaaagaugguuagag

SEQ ID NO: 1365 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaatgauucaaagaugguuaga

SEQ ID NO: 1366 - RNA, 23 nt, Artificial Sequence
  source: /note="Description of Artificial Sequence: Synthetic oligonucleotide"
accaaugauucaaagaugguuag

SEQ ID NO: 1367 - RNA, 23 nt, Artificial Sequence
  source: /note="Description of Artificial Sequence: Synthetic oligonucleotide"
auuccaaugauucaaagaugguu

SEQ ID NO: 1368 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuccaaugauucaaagauggu

SEQ ID NO: 1369 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuutccaaugauucaaagaugg

SEQ ID NO: 1370 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctutccaaugauucaaagau

SEQ ID NO: 1371 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutcauucuuuauucuuucca

SEQ ID NO: 1372 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutucauucuuuauucuuucc

SEQ ID NO: 1373 - RNA, 23 nt, Artificial Sequence
  source: /note="Description of Artificial Sequence: Synthetic oligonucleotide"
aaccuugaauuuguuucauucuu

SEQ ID NO: 1374 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacctugaauuuguuucauuc

SEQ ID NO: 1375 - RNA, 23 nt, Artificial Sequence
  source: /note="Description of Artificial Sequence: Synthetic oligonucleotide"
acaauuaaccuugaauuuguuuc

SEQ ID NO: 1376 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutgcuuuaugcagcuucaca

SEQ ID NO: 1377 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaucutgcuuuaugcagcuuca

SEQ ID NO: 1378 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatctugcuuuaugcagcuuc

SEQ ID NO: 1379 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaaucuugcuuuaugcagcuu

SEQ ID NO: 1380 - RNA, 23 nt, Artificial Sequence
  source: /note="Description of Artificial Sequence: Synthetic oligonucleotide"
aaguaaucuugcuuuaugcagcu

SEQ ID NO: 1381 - RNA, 23 nt, Artificial Sequence
  source: /note="Description of Artificial Sequence: Synthetic oligonucleotide"
agaguaaucuugcuuuaugcagc

SEQ ID NO: 1382 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagagtaaucuugcuuuaugca

SEQ ID NO: 1383 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auauagaguaaucuugcuuuaug

SEQ ID NO: 1384 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutgguuggauuuuuguauua

SEQ ID NO: 1385 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagtugguuggauuuuuguauu

SEQ ID NO: 1386 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagutgguuggauuuuuguau

SEQ ID NO: 1387 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugagtugguuggauuuuugua

SEQ ID NO: 1388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugaguugguuggauuuuugu

SEQ ID NO: 1389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautgaguugguuggauuuuug

SEQ ID NO: 1390 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaatugaguugguuggauuuuu

SEQ ID NO: 1391 - RNA, 23 nt, Artificial Sequence
  source: /note="Description of Artificial Sequence: Synthetic oligonucleotide"
aauaauugaguugguuggauuuu

SEQ ID NO: 1392 - RNA, 23 nt, Artificial Sequence
  source: /note="Description of Artificial Sequence: Synthetic oligonucleotide"
aaauaauugaguugguuggauuu

SEQ ID NO: 1393 - RNA, 23 nt, Artificial Sequence
  source: /note="Description of Artificial Sequence: Synthetic oligonucleotide"
acaauaauugaguugguuggauu

SEQ ID NO: 1394 - RNA, 23 nt, Artificial Sequence
  source: /note="Description of Artificial Sequence: Synthetic oligonucleotide"
aucaauaauugaguugguuggau

SEQ ID NO: 1395 - RNA, 23 nt, Artificial Sequence
  source: /note="Description of Artificial Sequence: Synthetic oligonucleotide"
acucaauaauugaguugguugga

SEQ ID NO: 1396 - RNA, 23 nt, Artificial Sequence
  source: /note="Description of Artificial Sequence: Synthetic oligonucleotide"
agcucaauaauugaguugguugg

SEQ ID NO: 1397 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctcaauaauugaguugguug

SEQ ID NO: 1398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugcucaauaauugaguugguu

SEQ ID NO: 1399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaaucuagaacauuguacgug

SEQ ID NO: 1400 - RNA, 23 nt, Artificial Sequence
  source: /note="Description of Artificial Sequence: Synthetic oligonucleotide"
aagaaaucuagaacauuguacgu

SEQ ID NO: 1401 - RNA, 23 nt, Artificial Sequence
  source: /note="Description of Artificial Sequence: Synthetic oligonucleotide"
aaagaaaucuagaacauuguacg

SEQ ID NO: 1402 - RNA, 23 nt, Artificial Sequence
  source: /note="Description of Artificial Sequence: Synthetic oligonucleotide"
aaaagaaaucuagaacauuguac

SEQ ID NO: 1403 - RNA, 23 nt, Artificial Sequence
  source: /note="Description of Artificial Sequence: Synthetic oligonucleotide"
agaaagaaaucuagaacauugua

SEQ ID NO: 1404 - RNA, 23 nt, Artificial Sequence
  source: /note="Description of Artificial Sequence: Synthetic oligonucleotide"
aggaaagaaaucuagaacauugu

SEQ ID NO: 1405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagggaaagaaaucuagaacau

SEQ ID NO: 1406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaagggaaagaaaucuagaaca

SEQ ID NO: 1407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuggcuucaaauguaaagauu

SEQ ID NO: 1408 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuutggcuucaaauguaaagau

SEQ ID NO: 1409 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacutuggcuucaaauguaaaga

SEQ ID NO: 1410 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauuactuuggcuucaaauguaa

SEQ ID NO: 1411 - RNA, 23 nt, Artificial Sequence
  source: /note="Description of Artificial Sequence: Synthetic oligonucleotide"
aaaauuacuuuggcuucaaaugu

SEQ ID NO: 1412 - RNA, 23 nt, Artificial Sequence
  source: /note="Description of Artificial Sequence: Synthetic oligonucleotide"
aguggaaauuacuuuggcuucaa

SEQ ID NO: 1413 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguggaaauuacuuuggcuuca

SEQ ID NO: 1414 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuaggtggaaauuacuuuggcu

SEQ ID NO: 1415 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucuagguggaaauuacuuuggc

SEQ ID NO: 1416 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctagguggaaauuacuuugg

SEQ ID NO: 1417 - RNA, 23 nt, Artificial Sequence
  source: /note="Description of Artificial Sequence: Synthetic oligonucleotide"
acuucagagacaagaucuugcuc

SEQ ID NO: 1418 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutctuggcucuucuaccucu

SEQ ID NO: 1419 - RNA, 23 nt, Artificial Sequence
  source: /note="Description of Artificial Sequence: Synthetic oligonucleotide"
agacagaagagacagagcuagga

SEQ ID NO: 1420 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacagaagagacagagcuagg

SEQ ID NO: 1421 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagacagaagagacagagcuag

SEQ ID NO: 1422 - RNA, 23 nt, Artificial Sequence
  source: /note="Description of Artificial Sequence: Synthetic oligonucleotide"
acaguccaagaucacaaagauag

SEQ ID NO: 1423 - RNA, 23 nt, Artificial Sequence
  source: /note="Description of Artificial Sequence: Synthetic oligonucleotide"
aguaaaauggaucacaggaaggg

SEQ ID NO: 1424 - RNA, 23 nt, Artificial Sequence
  source: /note="Description of Artificial Sequence: Synthetic oligonucleotide"
aaguaaaauggaucacaggaagg

SEQ ID NO: 1425 - RNA, 23 nt, Artificial Sequence
  source: /note="Description of Artificial Sequence: Synthetic oligonucleotide"
acaguaaaauggaucacaggaag

SEQ ID NO: 1426 - RNA, 23 nt, Artificial Sequence
  source: /note="Description of Artificial Sequence: Synthetic oligonucleotide"
agcaguaaaauggaucacaggaa

SEQ ID NO: 1427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcagtaaaauggaucacagga

SEQ ID NO: 1428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auucaggucauauauuuauaggc

SEQ ID NO: 1429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacuggaguuuucaggucaua

SEQ ID NO: 1430 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaactggaguuuucaggucau

SEQ ID NO: 1431 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagatagcugcagauccuuua

SEQ ID NO: 1432 - RNA, 23 nt, Artificial Sequence
  source: /note="Description of Artificial Sequence: Synthetic oligonucleotide"
acuuagauagcugcagauccuuu

SEQ ID NO: 1433 - RNA, 23 nt, Artificial Sequence
  source: /note="Description of Artificial Sequence: Synthetic oligonucleotide"
aaaaaccaagccuuagauagcug

SEQ ID NO: 1434 - RNA, 23 nt, Artificial Sequence
  source: /note="Description of Artificial Sequence: Synthetic oligonucleotide"
agaaaaccaagccuuagauagcu

SEQ ID NO: 1435 - RNA, 23 nt, Artificial Sequence
  source: /note="Description of Artificial Sequence: Synthetic oligonucleotide"
aaagaaaaccaagccuuagauag

SEQ ID NO: 1436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaagaaaaccaagccuuagaua

SEQ ID NO: 1437 - RNA, 23 nt, Artificial Sequence
  source: /note="Description of Artificial Sequence: Synthetic oligonucleotide"
aguaagaaaaccaagccuuagau

SEQ ID NO: 1438 - RNA, 23 nt, Artificial Sequence
  source: /note="Description of Artificial Sequence: Synthetic oligonucleotide"
aaguaagaaaaccaagccuuaga

SEQ ID NO: 1439 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacagtaagaaaaccaagccuu

SEQ ID NO: 1440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augacaguaagaaaaccaagccu

SEQ ID NO: 1441 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugacaguaagaaaaccaagcc

SEQ ID NO: 1442 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaugacaguaagaaaaccaagc

SEQ ID NO: 1443 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauatgacaguaagaaaaccaag

SEQ ID NO: 1444 - RNA, 23 nt, Artificial Sequence
  source: /note="Description of Artificial Sequence: Synthetic oligonucleotide"
acauaugacaguaagaaaaccaa

SEQ ID NO: 1445 - RNA, 23 nt, Artificial Sequence
  source: /note="Description of Artificial Sequence: Synthetic oligonucleotide"
aaucauaugacaguaagaaaacc

SEQ ID NO: 1446 - RNA, 23 nt, Artificial Sequence
  source: /note="Description of Artificial Sequence: Synthetic oligonucleotide"
auaucauaugacaguaagaaaac

SEQ ID NO: 1447 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguaucauaugacaguaagaaa

SEQ ID NO: 1448 - RNA, 23 nt, Artificial Sequence
  source: /note="Description of Artificial Sequence: Synthetic oligonucleotide"
aagguaucauaugacaguaagaa

SEQ ID NO: 1449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctctuuaccaaccgcagaaa

SEQ ID NO: 1450 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugtagggauuaaaucaccauu

SEQ ID NO: 1451 - RNA, 23 nt, Artificial Sequence
  source: /note="Description of Artificial Sequence: Synthetic oligonucleotide"
acauguagggauuaaaucaccau

SEQ ID NO: 1452 - RNA, 23 nt, Artificial Sequence
  source: /note="Description of Artificial Sequence: Synthetic oligonucleotide"
acagaagguuggauuuauacagu

SEQ ID NO: 1453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuatuagugacaucaagcacca

SEQ ID NO: 1454 - RNA, 23 nt, Artificial Sequence
  source: /note="Description of Artificial Sequence: Synthetic oligonucleotide"
auuuauuagugacaucaagcacc

SEQ ID NO: 1455 - RNA, 23 nt, Artificial Sequence
  source: /note="Description of Artificial Sequence: Synthetic oligonucleotide"
aauuuauuagugacaucaagcac

SEQ ID NO: 1456 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguutcauuuauuagugacauca

SEQ ID NO: 1457 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagutucauuuauuagugacauc

SEQ ID NO: 1458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcugacaguuucauuuauuagu

SEQ ID NO: 1459 - RNA, 23 nt, Homo sapiens
acuaccugccagugucucuuagg

SEQ ID NO: 1460 - RNA, 23 nt, Homo sapiens
cuaccugccagugucucuuagga

SEQ ID NO: 1461 - RNA, 23 nt, Homo sapiens
uaccugccagugucucuuaggag

SEQ ID NO: 1462 - RNA, 23 nt, Homo sapiens
ccugccagugucucuuaggagug

SEQ ID NO: 1463 - RNA, 23 nt, Homo sapiens
cugccagugucucuuaggaguga

SEQ ID NO: 1464 - RNA, 23 nt, Homo sapiens
ugccagugucucuuaggagugag

SEQ ID NO: 1465 - RNA, 23 nt, Homo sapiens
gccagugucucuuaggagugagg

SEQ ID NO: 1466 - RNA, 23 nt, Homo sapiens
ccagugucucuuaggagugaggu

SEQ ID NO: 1467 - RNA, 23 nt, Homo sapiens
gguggagaaaaaugcagauccag

SEQ ID NO: 1468 - RNA, 23 nt, Homo sapiens
auccagagacaacccuuuuggcc

SEQ ID NO: 1469 - RNA, 23 nt, Homo sapiens
ccagagacaacccuuuuggccua

SEQ ID NO: 1470 - RNA, 23 nt, Homo sapiens
uugcacagugaugcucuccaagu

SEQ ID NO: 1471 - RNA, 23 nt, Homo sapiens
ugcacagugaugcucuccaagua

SEQ ID NO: 1472 - RNA, 23 nt, Homo sapiens
gugaugcucuccaaguaugaucg

SEQ ID NO: 1473 - RNA, 23 nt, Homo sapiens
ugaugcucuccaaguaugaucgu

SEQ ID NO: 1474 - RNA, 23 nt, Homo sapiens
gaugcucuccaaguaugaucguc

SEQ ID NO: 1475 - RNA, 23 nt, Homo sapiens
augcucuccaaguaugaucgucu

SEQ ID NO: 1476 - RNA, 23 nt, Homo sapiens
ugcucuccaaguaugaucgucug

SEQ ID NO: 1477 - RNA, 23 nt, Homo sapiens
augaucgucugcagaacaagauc

SEQ ID NO: 1478 - RNA, 23 nt, Homo sapiens
aucgucugcagaacaagaucguc

SEQ ID NO: 1479 - RNA, 23 nt, Homo sapiens
ucgucugcagaacaagaucgucc

SEQ ID NO: 1480 - RNA, 23 nt, Homo sapiens
cgucugcagaacaagaucgucca

SEQ ID NO: 1481 - RNA, 23 nt, Homo sapiens
cugcagaacaagaucguccacuu

SEQ ID NO: 1482 - RNA, 23 nt, Homo sapiens
ugcagaacaagaucguccacuuu

SEQ ID NO: 1483 - RNA, 23 nt, Homo sapiens
cagaacaagaucguccacuuuuc

SEQ ID NO: 1484 - RNA, 23 nt, Homo sapiens
agaacaagaucguccacuuuucu

SEQ ID NO: 1485 - RNA, 23 nt, Homo sapiens
gaacaagaucguccacuuuucug

SEQ ID NO: 1486 - RNA, 23 nt, Homo sapiens
aacaagaucguccacuuuucugc

SEQ ID NO: 1487 - RNA, 23 nt, Homo sapiens
acaagaucguccacuuuucugcc

SEQ ID NO: 1488 - RNA, 23 nt, Homo sapiens
aucguccacuuuucugccaaugc

SEQ ID NO: 1489 - RNA, 23 nt, Homo sapiens
ucguccacuuuucugccaaugcc

SEQ ID NO: 1490 - RNA, 23 nt, Homo sapiens
ucugcuccuugcaccauguugca

SEQ ID NO: 1491 - RNA, 23 nt, Homo sapiens
gcuccuugcaccauguugcagug

SEQ ID NO: 1492 - RNA, 23 nt, Homo sapiens
ccuugcaccauguugcagugaca

SEQ ID NO: 1493 - RNA, 23 nt, Homo sapiens
ugcaccauguugcagugacaacu

SEQ ID NO: 1494 - RNA, 23 nt, Homo sapiens
gcaccauguugcagugacaacug

SEQ ID NO: 1495 - RNA, 23 nt, Homo sapiens
gcaggagagaauugccaaaagcc

SEQ ID NO: 1496 - RNA, 23 nt, Homo sapiens
caggagagaauugccaaaagcca

SEQ ID NO: 1497 - RNA, 23 nt, Homo sapiens
ccuggcaucgucaugaguaugua

SEQ ID NO: 1498 - RNA, 23 nt, Homo sapiens
cuggcaucgucaugaguauguac

SEQ ID NO: 1499 - RNA, 23 nt, Homo sapiens
uggcaucgucaugaguauguaca

SEQ ID NO: 1500 - RNA, 23 nt, Homo sapiens
ggcaucgucaugaguauguacac

SEQ ID NO: 1501 - RNA, 23 nt, Homo sapiens
gcaucgucaugaguauguacaca

SEQ ID NO: 1502 - RNA, 23 nt, Homo sapiens
aucgucaugaguauguacacacu

SEQ ID NO: 1503 - RNA, 23 nt, Homo sapiens
ucgucaugaguauguacacacug

SEQ ID NO: 1504 - RNA, 23 nt, Homo sapiens
cgucaugaguauguacacacugc

SEQ ID NO: 1505 - RNA, 23 nt, Homo sapiens
agaaugccuuccaaggaaaucug

SEQ ID NO: 1506 - RNA, 23 nt, Homo sapiens
gaaugccuuccaaggaaaucugu

SEQ ID NO: 1507 - RNA, 23 nt, Homo sapiens
aaugccuuccaaggaaaucugug

SEQ ID NO: 1508 - RNA, 23 nt, Homo sapiens
augccuuccaaggaaaucugugc

SEQ ID NO: 1509 - RNA, 23 nt, Homo sapiens
ugccuuccaaggaaaucugugcc

SEQ ID NO: 1510 - RNA, 23 nt, Homo sapiens
uugagaugaaguucaagaauaug

SEQ ID NO: 1511 - RNA, 23 nt, Homo sapiens
gagaugaaguucaagaauaugcu

SEQ ID NO: 1512 - RNA, 23 nt, Homo sapiens
ugaaguucaagaauaugcuguuu

SEQ ID NO: 1513 - RNA, 23 nt, Homo sapiens
gaaguucaagaauaugcuguuuc

SEQ ID NO: 1514 - RNA, 23 nt, Homo sapiens
aaguucaagaauaugcuguuucc

SEQ ID NO: 1515 - RNA, 23 nt, Homo sapiens
aguucaagaauaugcuguuuccu

SEQ ID NO: 1516 - RNA, 23 nt, Homo sapiens
ucaagaauaugcuguuuccuaug

SEQ ID NO: 1517 - RNA, 23 nt, Homo sapiens
gggggaguauuucucagcauuca

SEQ ID NO: 1518 - RNA, 23 nt, Homo sapiens
ggggaguauuucucagcauucaa

SEQ ID NO: 1519 - RNA, 23 nt, Homo sapiens
gggaguauuucucagcauucaag

SEQ ID NO: 1520 - RNA, 23 nt, Homo sapiens
ggaguauuucucagcauucaagc

SEQ ID NO: 1521 - RNA, 23 nt, Homo sapiens
gaguauuucucagcauucaagca

SEQ ID NO: 1522 - RNA, 23 nt, Homo sapiens
caguggcaugagaguuuuauuca

SEQ ID NO: 1523 - RNA, 23 nt, Homo sapiens
guggcaugagaguuuuauucaag

SEQ ID NO: 1524 - RNA, 23 nt, Homo sapiens
ggcaugagaguuuuauucaagcc

SEQ ID NO: 1525 - RNA, 23 nt, Homo sapiens
acccucacccucagcuucuucuu

SEQ ID NO: 1526 - RNA, 23 nt, Homo sapiens
ccucacccucagcuucuucuuca

SEQ ID NO: 1527 - RNA, 23 nt, Homo sapiens
cuucuucaaguucuaccugacag

SEQ ID NO: 1528 - RNA, 23 nt, Homo sapiens
acuuucgccagugcaacuuuacu

SEQ ID NO: 1529 - RNA, 23 nt, Homo sapiens
cuuucgccagugcaacuuuacug

SEQ ID NO: 1530 - RNA, 23 nt, Homo sapiens
gguuccaggguuuguuuguuuca

SEQ ID NO: 1531 - RNA, 23 nt, Homo sapiens
uccaggguuuguuuguuucauuu

SEQ ID NO: 1532 - RNA, 23 nt, Homo sapiens
caggguuuguuuguuucauuucc

SEQ ID NO: 1533 - RNA, 23 nt, Homo sapiens
aggguuuguuuguuucauuuccg

SEQ ID NO: 1534 - RNA, 23 nt, Homo sapiens
guuuguuuguuucauuuccgcug

SEQ ID NO: 1535 - RNA, 23 nt, Homo sapiens
uguuccugggaguaacauaacug

SEQ ID NO: 1536 - RNA, 23 nt, Homo sapiens
cugggaguaacauaacuggaauu

SEQ ID NO: 1537 - RNA, 23 nt, Homo sapiens
aguaacauaacuggaauuuguaa

SEQ ID NO: 1538 - RNA, 23 nt, Homo sapiens
guaacauaacuggaauuuguaau

SEQ ID NO: 1539 - RNA, 23 nt, Homo sapiens
ugcgaaggauaagguuacuugug

SEQ ID NO: 1540 - RNA, 23 nt, Homo sapiens
gcgaaggauaagguuacuugugu

SEQ ID NO: 1541 - RNA, 23 nt, Homo sapiens
aggggugaaaaucaccuaugaag

SEQ ID NO: 1542 - RNA, 23 nt, Homo sapiens
aaaaucaccuaugaagaacuacc

SEQ ID NO: 1543 - RNA, 23 nt, Homo sapiens
aaaucaccuaugaagaacuacca

SEQ ID NO: 1544 - RNA, 23 nt, Homo sapiens
acuaccagccauuaucacaauug

SEQ ID NO: 1545 - RNA, 23 nt, Homo sapiens
aagaacaacuccuuuuauggacc

SEQ ID NO: 1546 - RNA, 23 nt, Homo sapiens
guggccaagagcacuucuaccug

SEQ ID NO: 1547 - RNA, 23 nt, Homo sapiens
aagagcacuucuaccuggagacu

SEQ ID NO: 1548 - RNA, 23 nt, Homo sapiens
gagcacuucuaccuggagacuca

SEQ ID NO: 1549 - RNA, 23 nt, Homo sapiens
agcacuucuaccuggagacucac

SEQ ID NO: 1550 - RNA, 23 nt, Homo sapiens
acucacugcaccauugcuguucc

SEQ ID NO: 1551 - RNA, 23 nt, Homo sapiens
cucacugcaccauugcuguucca

SEQ ID NO: 1552 - RNA, 23 nt, Homo sapiens
caccauugcuguuccaaaaggcg

SEQ ID NO: 1553 - RNA, 23 nt, Homo sapiens
ggagcucuuugugucuacacaga

SEQ ID NO: 1554 - RNA, 23 nt, Homo sapiens
gagcucuuugugucuacacagaa

SEQ ID NO: 1555 - RNA, 23 nt, Homo sapiens
agcucuuugugucuacacagaac

SEQ ID NO: 1556 - RNA, 23 nt, Homo sapiens
gcucuuugugucuacacagaaca

SEQ ID NO: 1557 - RNA, 23 nt, Homo sapiens
cucuuugugucuacacagaacac

SEQ ID NO: 1558 - RNA, 23 nt, Homo sapiens
ucuuugugucuacacagaacacc

SEQ ID NO: 1559 - RNA, 23 nt, Homo sapiens
cuacacagaacaccaugaagacc

SEQ ID NO: 1560 - RNA, 23 nt, Homo sapiens
cagagcuuuguugcaaaaauguu

SEQ ID NO: 1561 - RNA, 23 nt, Homo sapiens
agagcuuuguugcaaaaauguug

SEQ ID NO: 1562 - RNA, 23 nt, Homo sapiens
ccaggaucucucucagaguauua

SEQ ID NO: 1563 - RNA, 23 nt, Homo sapiens
caggaucucucucagaguauuau

SEQ ID NO: 1564 - RNA, 23 nt, Homo sapiens
aggaucucucucagaguauuaug

SEQ ID NO: 1565 - RNA, 23 nt, Homo sapiens
ggaucucucucagaguauuaugg

SEQ ID NO: 1566 - RNA, 23 nt, Homo sapiens
gaucucucucagaguauuaugga

SEQ ID NO: 1567 - RNA, 23 nt, Homo sapiens
aucucucucagaguauuauggaa

SEQ ID NO: 1568 - RNA, 23 nt, Homo sapiens
ucucucucagaguauuauggaac

SEQ ID NO: 1569 - RNA, 23 nt, Homo sapiens
cucucucagaguauuauggaacg

SEQ ID NO: 1570 - RNA, 23 nt, Homo sapiens
ucucucagaguauuauggaacga

SEQ ID NO: 1571 - RNA, 23 nt, Homo sapiens
ucucagaguauuauggaacgagc

SEQ ID NO: 1572 - RNA, 23 nt, Homo sapiens
cucagaguauuauggaacgagcu

SEQ ID NO: 1573 - RNA, 23 nt, Homo sapiens
cggcugugcaaaaccaaccuucc

SEQ ID NO: 1574 - RNA, 23 nt, Homo sapiens
ggcugugcaaaaccaaccuuccc

SEQ ID NO: 1575 - RNA, 23 nt, Homo sapiens
gaccugacacacuucaaccagaa

SEQ ID NO: 1576 - RNA, 23 nt, Homo sapiens
ccugacacacuucaaccagaagc

SEQ ID NO: 1577 - RNA, 23 nt, Homo sapiens
cugacacacuucaaccagaagcu

SEQ ID NO: 1578 - RNA, 23 nt, Homo sapiens
acacacuucaaccagaagcuuga

SEQ ID NO: 1579 - RNA, 23 nt, Homo sapiens
gaaugccuagcaagcucucagua

SEQ ID NO: 1580 - RNA, 23 nt, Homo sapiens
ugccuagcaagcucucaguauca

SEQ ID NO: 1581 - RNA, 23 nt, Homo sapiens
gccuagcaagcucucaguaucau

SEQ ID NO: 1582 - RNA, 23 nt, Homo sapiens
ccuagcaagcucucaguaucaug

SEQ ID NO: 1583 - RNA, 23 nt, Homo sapiens
cuagcaagcucucaguaucaugc

SEQ ID NO: 1584 - RNA, 23 nt, Homo sapiens
agcaagcucucaguaucaugcuc

SEQ ID NO: 1585 - RNA, 23 nt, Homo sapiens
ugcucggaagagugagguugaca

SEQ ID NO: 1586 - RNA, 23 nt, Homo sapiens
acaaggagaauuguuggaaaaag

SEQ ID NO: 1587 - RNA, 23 nt, Homo sapiens
cccaccaaguuuggaauaagcuu

SEQ ID NO: 1588 - RNA, 23 nt, Homo sapiens
ccaccaaguuuggaauaagcuuu

SEQ ID NO: 1589 - RNA, 23 nt, Homo sapiens
acaguuccuuuucugaaucaggc

SEQ ID NO: 1590 - RNA, 23 nt, Homo sapiens
caguuccuuuucugaaucaggca

SEQ ID NO: 1591 - RNA, 23 nt, Homo sapiens
aguuccuuuucugaaucaggcag

SEQ ID NO: 1592 - RNA, 23 nt, Homo sapiens
ccuacuucauguguacacagaug

SEQ ID NO: 1593 - RNA, 23 nt, Homo sapiens
gccaaggccuucauaccaaaaug

SEQ ID NO: 1594 - RNA, 23 nt, Homo sapiens
ccaaggccuucauaccaaaaugg

SEQ ID NO: 1595 - RNA, 23 nt, Homo sapiens
aggccuucauaccaaaauggucc

SEQ ID NO: 1596 - RNA, 23 nt, Homo sapiens
cccaccucuaagauuuauaucag

SEQ ID NO: 1597 - RNA, 23 nt, Homo sapiens
ccaccucuaagauuuauaucagc

SEQ ID NO: 1598 - RNA, 23 nt, Homo sapiens
cagcgagacaagcacuaacacug

SEQ ID NO: 1599 - RNA, 23 nt, Homo sapiens
agcgagacaagcacuaacacugu

SEQ ID NO: 1600 - RNA, 23 nt, Homo sapiens
gcgagacaagcacuaacacugug

SEQ ID NO: 1601 - RNA, 23 nt, Homo sapiens
cgagacaagcacuaacacugugc

SEQ ID NO: 1602 - RNA, 23 nt, Homo sapiens
ugcggcuugucagaccaucuuga

SEQ ID NO: 1603 - RNA, 23 nt, Homo sapiens
gcggcuugucagaccaucuugaa

SEQ ID NO: 1604 - RNA, 23 nt, Homo sapiens
cggcuugucagaccaucuugaaa

SEQ ID NO: 1605 - RNA, 23 nt, Homo sapiens
ggcuugucagaccaucuugaaaa

SEQ ID NO: 1606 - RNA, 23 nt, Homo sapiens
gcuugucagaccaucuugaaaag

SEQ ID NO: 1607 - RNA, 23 nt, Homo sapiens
cuugucagaccaucuugaaaagg

SEQ ID NO: 1608 - RNA, 23 nt, Homo sapiens
uugucagaccaucuugaaaaggc

SEQ ID NO: 1609 - RNA, 23 nt, Homo sapiens
ugucagaccaucuugaaaaggcu

SEQ ID NO: 1610 - RNA, 23 nt, Homo sapiens
gaacccuacaagaagaagaaucc

SEQ ID NO: 1611 - RNA, 23 nt, Homo sapiens
gucugccacuggguuuuauagaa

SEQ ID NO: 1612 - RNA, 23 nt, Homo sapiens
ucugccacuggguuuuauagaac

SEQ ID NO: 1613 - RNA, 23 nt, Homo sapiens
gccacuggguuuuauagaacacc

SEQ ID NO: 1614 - RNA, 23 nt, Homo sapiens
ccacuggguuuuauagaacaccc

SEQ ID NO: 1615 - RNA, 23 nt, Homo sapiens
cuggguuuuauagaacacccaau

SEQ ID NO: 1616 - RNA, 23 nt, Homo sapiens
uggguuuuauagaacacccaauc

SEQ ID NO: 1617 - RNA, 23 nt, Homo sapiens
ucugggcuacagcuuugagacua

SEQ ID NO: 1618 - RNA, 23 nt, Homo sapiens
cugggcuacagcuuugagacuaa

SEQ ID NO: 1619 - RNA, 23 nt, Homo sapiens
gggcuacagcuuugagacuaacu

SEQ ID NO: 1620 - RNA, 23 nt, Homo sapiens
ggcuacagcuuugagacuaacuc

SEQ ID NO: 1621 - RNA, 23 nt, Homo sapiens
gcuacagcuuugagacuaacuca

SEQ ID NO: 1622 - RNA, 23 nt, Homo sapiens
cuacagcuuugagacuaacucag

SEQ ID NO: 1623 - RNA, 23 nt, Homo sapiens
uacagcuuugagacuaacucagg

SEQ ID NO: 1624 - RNA, 23 nt, Homo sapiens
acagcuuugagacuaacucaggg

SEQ ID NO: 1625 - RNA, 23 nt, Homo sapiens
cccuuccacuacuucagcuaugg

SEQ ID NO: 1626 - RNA, 23 nt, Homo sapiens
ccuuccacuacuucagcuauggg

SEQ ID NO: 1627 - RNA, 23 nt, Homo sapiens
ggguggcuugcucugaaguagaa

SEQ ID NO: 1628 - RNA, 23 nt, Homo sapiens
gguggcuugcucugaaguagaaa

SEQ ID NO: 1629 - RNA, 23 nt, Homo sapiens
guggcuugcucugaaguagaaau

SEQ ID NO: 1630 - RNA, 23 nt, Homo sapiens
uggcuugcucugaaguagaaauc

SEQ ID NO: 1631 - RNA, 23 nt, Homo sapiens
ugccuaacaggagaucauaagaa

SEQ ID NO: 1632 - RNA, 23 nt, Homo sapiens
gccuaacaggagaucauaagaac

SEQ ID NO: 1633 - RNA, 23 nt, Homo sapiens
ccuaacaggagaucauaagaacc

SEQ ID NO: 1634 - RNA, 23 nt, Homo sapiens
cuaacaggagaucauaagaaccu

SEQ ID NO: 1635 - RNA, 23 nt, Homo sapiens
aaccuccgcacagauauugucau

SEQ ID NO: 1636 - RNA, 23 nt, Homo sapiens
accuccgcacagauauugucaug

SEQ ID NO: 1637 - RNA, 23 nt, Homo sapiens
uguuggcuccagucuaaacccug

SEQ ID NO: 1638 - RNA, 23 nt, Homo sapiens
ucuuccuggcugcuucuaucuuc

SEQ ID NO: 1639 - RNA, 23 nt, Homo sapiens
cuuccuggcugcuucuaucuucu

SEQ ID NO: 1640 - RNA, 23 nt, Homo sapiens
uuccuggcugcuucuaucuucuu

SEQ ID NO: 1641 - RNA, 23 nt, Homo sapiens
uccuggcugcuucuaucuucuuu

SEQ ID NO: 1642 - RNA, 23 nt, Homo sapiens
ccuggcugcuucuaucuucuuug

SEQ ID NO: 1643 - RNA, 23 nt, Homo sapiens
uggcugcuucuaucuucuuugcc

SEQ ID NO: 1644 - RNA, 23 nt, Homo sapiens
ggcugcuucuaucuucuuugcca

SEQ ID NO: 1645 - RNA, 23 nt, Homo sapiens
gcugcuucuaucuucuuugccau

SEQ ID NO: 1646 - RNA, 23 nt, Homo sapiens
cugcuucuaucuucuuugccauc

SEQ ID NO: 1647 - RNA, 23 nt, Homo sapiens
ugcuucuaucuucuuugccauca

SEQ ID NO: 1648 - RNA, 23 nt, Homo sapiens
gcuucuaucuucuuugccaucaa

SEQ ID NO: 1649 - RNA, 23 nt, Homo sapiens
cuucuaucuucuuugccaucaaa

SEQ ID NO: 1650 - RNA, 23 nt, Homo sapiens
uucuaucuucuuugccaucaaag

SEQ ID NO: 1651 - RNA, 23 nt, Homo sapiens
ucuaucuucuuugccaucaaaga

SEQ ID NO: 1652 - RNA, 23 nt, Homo sapiens
cuaucuucuuugccaucaaagau

SEQ ID NO: 1653 - RNA, 23 nt, Homo sapiens
aucuucuuugccaucaaagaugc

SEQ ID NO: 1654 - RNA, 23 nt, Homo sapiens
ucgagcucagcacacagguaaua

SEQ ID NO: 1655 - RNA, 23 nt, Homo sapiens
agcucagcacacagguaauaacg

SEQ ID NO: 1656 - RNA, 23 nt, Homo sapiens
gcucagcacacagguaauaacgu

SEQ ID NO: 1657 - RNA, 23 nt, Homo sapiens
cucagcacacagguaauaacgug

SEQ ID NO: 1658 - RNA, 23 nt, Homo sapiens
acacagguaauaacgugaaggaa

SEQ ID NO: 1659 - RNA, 23 nt, Homo sapiens
cacagguaauaacgugaaggaac

SEQ ID NO: 1660 - RNA, 23 nt, Homo sapiens
acagguaauaacgugaaggaacu

SEQ ID NO: 1661 - RNA, 23 nt, Homo sapiens
uaauaacgugaaggaacucuucc

SEQ ID NO: 1662 - RNA, 23 nt, Homo sapiens
aauaacgugaaggaacucuuccg

SEQ ID NO: 1663 - RNA, 23 nt, Homo sapiens
gucccagaaaacugcaaacccug

SEQ ID NO: 1664 - RNA, 23 nt, Homo sapiens
accacagaacauggaucuauuaa

SEQ ID NO: 1665 - RNA, 23 nt, Homo sapiens
ccacagaacauggaucuauuaaa

SEQ ID NO: 1666 - RNA, 23 nt, Homo sapiens
cacagaacauggaucuauuaaag

SEQ ID NO: 1667 - RNA, 23 nt, Homo sapiens
acagaacauggaucuauuaaagu

SEQ ID NO: 1668 - RNA, 23 nt, Homo sapiens
cagaacauggaucuauuaaaguc

SEQ ID NO: 1669 - RNA, 23 nt, Homo sapiens
agaacauggaucuauuaaaguca

SEQ ID NO: 1670 - RNA, 23 nt, Homo sapiens
gaacauggaucuauuaaagucac

SEQ ID NO: 1671 - RNA, 23 nt, Homo sapiens
aacauggaucuauuaaagucaca

SEQ ID NO: 1672 - RNA, 23 nt, Homo sapiens
acauggaucuauuaaagucacag

SEQ ID NO: 1673 - RNA, 23 nt, Homo sapiens
cauggaucuauuaaagucacaga

SEQ ID NO: 1674 - RNA, 23 nt, Homo sapiens
auggaucuauuaaagucacagaa

SEQ ID NO: 1675 - RNA, 23 nt, Homo sapiens
uggaucuauuaaagucacagaau

SEQ ID NO: 1676 - RNA, 23 nt, Homo sapiens
acacaaugauaagcaaauucaaa

SEQ ID NO: 1677 - RNA, 23 nt, Homo sapiens
cacaaugauaagcaaauucaaaa

SEQ ID NO: 1678 - RNA, 23 nt, Homo sapiens
caaugauaagcaaauucaaaacu

SEQ ID NO: 1679 - RNA, 23 nt, Homo sapiens
uuaugccuaaauggugaauaugc

SEQ ID NO: 1680 - RNA, 23 nt, Homo sapiens
uaugccuaaauggugaauaugca

SEQ ID NO: 1681 - RNA, 23 nt, Homo sapiens
augccuaaauggugaauaugcaa

SEQ ID NO: 1682 - RNA, 23 nt, Homo sapiens
ugccuaaauggugaauaugcaau

SEQ ID NO: 1683 - RNA, 23 nt, Homo sapiens
gccuaaauggugaauaugcaauu

SEQ ID NO: 1684 - RNA, 23 nt, Homo sapiens
uaaauggugaauaugcaauuagg

SEQ ID NO: 1685 - RNA, 23 nt, Homo sapiens
gucgggaaggguuugugcuauuc

SEQ ID NO: 1686 - RNA, 23 nt, Homo sapiens
ucgggaaggguuugugcuauucc

SEQ ID NO: 1687 - RNA, 23 nt, Homo sapiens
cgggaaggguuugugcuauuccc

SEQ ID NO: 1688 - RNA, 23 nt, Homo sapiens
cuguauaaccucaaguucugaug

SEQ ID NO: 1689 - RNA, 23 nt, Homo sapiens
uguauaaccucaaguucugaugg

SEQ ID NO: 1690 - RNA, 23 nt, Homo sapiens
aaccucaaguucugauggugucu

SEQ ID NO: 1691 - RNA, 23 nt, Homo sapiens
cucaaguucugauggugucuguc

SEQ ID NO: 1692 - RNA, 23 nt, Homo sapiens
ucccacaaaccucuagaagcuua

SEQ ID NO: 1693 - RNA, 23 nt, Homo sapiens
ccacaaaccucuagaagcuuaaa

SEQ ID NO: 1694 - RNA, 23 nt, Homo sapiens
acaaaccucuagaagcuuaaacc

SEQ ID NO: 1695 - RNA, 23 nt, Homo sapiens
caaaccucuagaagcuuaaaccg

SEQ ID NO: 1696 - RNA, 23 nt, Homo sapiens
ccuggccuucaaaccaaugaaca

SEQ ID NO: 1697 - RNA, 23 nt, Homo sapiens
cuggccuucaaaccaaugaacag

SEQ ID NO: 1698 - RNA, 23 nt, Homo sapiens
uggccuucaaaccaaugaacagc

SEQ ID NO: 1699 - RNA, 23 nt, Homo sapiens
cuucaaaccaaugaacagcaaag

SEQ ID NO: 1700 - RNA, 23 nt, Homo sapiens
augaacagcaaagcauaaccuug

SEQ ID NO: 1701 - RNA, 23 nt, Homo sapiens
ugaacagcaaagcauaaccuuga

SEQ ID NO: 1702 - RNA, 23 nt, Homo sapiens
acagcaaagcauaaccuugaauc

SEQ ID NO: 1703 - RNA, 23 nt, Homo sapiens
cagcaaagcauaaccuugaaucu

SEQ ID NO: 1704 - RNA, 23 nt, Homo sapiens
agcaaagcauaaccuugaaucua

SEQ ID NO: 1705 - RNA, 23 nt, Homo sapiens
aagcauaaccuugaaucuauacu

SEQ ID NO: 1706 - RNA, 23 nt, Homo sapiens
agcauaaccuugaaucuauacuc

SEQ ID NO: 1707 - RNA, 23 nt, Homo sapiens
gcauaaccuugaaucuauacuca

SEQ ID NO: 1708 - RNA, 23 nt, Homo sapiens
cauaaccuugaaucuauacucaa

SEQ ID NO: 1709 - RNA, 23 nt, Homo sapiens
auaaccuugaaucuauacucaaa

SEQ ID NO: 1710 - RNA, 23 nt, Homo sapiens
uaaccuugaaucuauacucaaau

SEQ ID NO: 1711 - RNA, 23 nt, Homo sapiens
aaccuugaaucuauacucaaauu

SEQ ID NO: 1712 - RNA, 23 nt, Homo sapiens
ugaaucuauacucaaauuuugca

SEQ ID NO: 1713 - RNA, 23 nt, Homo sapiens
gaaucuauacucaaauuuugcaa

SEQ ID NO: 1714 - RNA, 23 nt, Homo sapiens
aagguuaaauccucuaaccaucu

SEQ ID NO: 1715 - RNA, 23 nt, Homo sapiens
guuaaauccucuaaccaucuuug

SEQ ID NO: 1716 - RNA, 23 nt, Homo sapiens
uuaaauccucuaaccaucuuuga

SEQ ID NO: 1717 - RNA, 23 nt, Homo sapiens
uaaauccucuaaccaucuuugaa

SEQ ID NO: 1718 - RNA, 23 nt, Homo sapiens
aaauccucuaaccaucuuugaau

SEQ ID NO: 1719 - RNA, 23 nt, Homo sapiens
aauccucuaaccaucuuugaauc

SEQ ID NO: 1720 - RNA, 23 nt, Homo sapiens
auccucuaaccaucuuugaauca

SEQ ID NO: 1721 - RNA, 23 nt, Homo sapiens
uccucuaaccaucuuugaaucau

SEQ ID NO: 1722 - RNA, 23 nt, Homo sapiens
ccucuaaccaucuuugaaucauu

SEQ ID NO: 1723 - RNA, 23 nt, Homo sapiens
cucuaaccaucuuugaaucauug

SEQ ID NO: 1724 - RNA, 23 nt, Homo sapiens
ucuaaccaucuuugaaucauugg

SEQ ID NO: 1725 - RNA, 23 nt, Homo sapiens
cuaaccaucuuugaaucauugga

SEQ ID NO: 1726 - RNA, 23 nt, Homo sapiens
aaccaucuuugaaucauuggaaa

SEQ ID NO: 1727 - RNA, 23 nt, Homo sapiens
accaucuuugaaucauuggaaag

SEQ ID NO: 1728 - RNA, 23 nt, Homo sapiens
ccaucuuugaaucauuggaaaga

SEQ ID NO: 1729 - RNA, 23 nt, Homo sapiens
aucuuugaaucauuggaaagaau

SEQ ID NO: 1730 - RNA, 23 nt, Homo sapiens
uggaaagaauaaagaaugaaaca

SEQ ID NO: 1731 - RNA, 23 nt, Homo sapiens
ggaaagaauaaagaaugaaacaa

SEQ ID NO: 1732 - RNA, 23 nt, Homo sapiens
aagaaugaaacaaauucaagguu

SEQ ID NO: 1733 - RNA, 23 nt, Homo sapiens
gaaugaaacaaauucaagguuaa

SEQ ID NO: 1734 - RNA, 23 nt, Homo sapiens
gaaacaaauucaagguuaauugg

SEQ ID NO: 1735 - RNA, 23 nt, Homo sapiens
ugugaagcugcauaaagcaagau

SEQ ID NO: 1736 - RNA, 23 nt, Homo sapiens
ugaagcugcauaaagcaagauua

SEQ ID NO: 1737 - RNA, 23 nt, Homo sapiens
gaagcugcauaaagcaagauuac

SEQ ID NO: 1738 - RNA, 23 nt, Homo sapiens
aagcugcauaaagcaagauuacu

SEQ ID NO: 1739 - RNA, 23 nt, Homo sapiens
agcugcauaaagcaagauuacuc

SEQ ID NO: 1740 - RNA, 23 nt, Homo sapiens
gcugcauaaagcaagauuacucu

SEQ ID NO: 1741 - RNA, 23 nt, Homo sapiens
ugcauaaagcaagauuacucuau

SEQ ID NO: 1742 - RNA, 23 nt, Homo sapiens
cauaaagcaagauuacucuauaa

SEQ ID NO: 1743 - RNA, 23 nt, Homo sapiens
uaauacaaaaauccaaccaacuc

SEQ ID NO: 1744 - RNA, 23 nt, Homo sapiens
aauacaaaaauccaaccaacuca

SEQ ID NO: 1745 - RNA, 23 nt, Homo sapiens
auacaaaaauccaaccaacucaa

SEQ ID NO: 1746 - RNA, 23 nt, Homo sapiens
uacaaaaauccaaccaacucaau

SEQ ID NO: 1747 - RNA, 23 nt, Homo sapiens
acaaaaauccaaccaacucaauu

SEQ ID NO: 1748 - RNA, 23 nt, Homo sapiens
caaaaauccaaccaacucaauua

SEQ ID NO: 1749 - RNA, 23 nt, Homo sapiens
aaaaauccaaccaacucaauuau

SEQ ID NO: 1750 - RNA, 23 nt, Homo sapiens
aaaauccaaccaacucaauuauu

SEQ ID NO: 1751 - RNA, 23 nt, Homo sapiens
aaauccaaccaacucaauuauug

SEQ ID NO: 1752 - RNA, 23 nt, Homo sapiens
aauccaaccaacucaauuauuga

SEQ ID NO: 1753 - RNA, 23 nt, Homo sapiens
auccaaccaacucaauuauugag

SEQ ID NO: 1754 - RNA, 23 nt, Homo sapiens
uccaaccaacucaauuauugagc

SEQ ID NO: 1755 - RNA, 23 nt, Homo sapiens
ccaaccaacucaauuauugagca

SEQ ID NO: 1756 - RNA, 23 nt, Homo sapiens
caaccaacucaauuauugagcac

SEQ ID NO: 1757 - RNA, 23 nt, Homo sapiens
aaccaacucaauuauugagcacg

SEQ ID NO: 1758 - RNA, 23 nt, Homo sapiens
cacguacaauguucuagauuucu

SEQ ID NO: 1759 - RNA, 23 nt, Homo sapiens
acguacaauguucuagauuucuu

SEQ ID NO: 1760 - RNA, 23 nt, Homo sapiens
cguacaauguucuagauuucuuu

SEQ ID NO: 1761 - RNA, 23 nt, Homo sapiens
guacaauguucuagauuucuuuc

SEQ ID NO: 1762 - RNA, 23 nt, Homo sapiens
uacaauguucuagauuucuuucc

SEQ ID NO: 1763 - RNA, 23 nt, Homo sapiens
acaauguucuagauuucuuuccc

SEQ ID NO: 1764 - RNA, 23 nt, Homo sapiens
auguucuagauuucuuucccuuc

SEQ ID NO: 1765 - RNA, 23 nt, Homo sapiens
uguucuagauuucuuucccuucc

SEQ ID NO: 1766 - RNA, 23 nt, Homo sapiens
aaucuuuacauuugaagccaaag

SEQ ID NO: 1767 - RNA, 23 nt, Homo sapiens
aucuuuacauuugaagccaaagu

SEQ ID NO: 1768 - RNA, 23 nt, Homo sapiens
ucuuuacauuugaagccaaagua

SEQ ID NO: 1769 - RNA, 23 nt, Homo sapiens
uuacauuugaagccaaaguaauu

SEQ ID NO: 1770 - RNA, 23 nt, Homo sapiens
acauuugaagccaaaguaauuuc

SEQ ID NO: 1771 - RNA, 23 nt, Homo sapiens
uugaagccaaaguaauuuccacc

SEQ ID NO: 1772 - RNA, 23 nt, Homo sapiens
ugaagccaaaguaauuuccaccu

SEQ ID NO: 1773 - RNA, 23 nt, Homo sapiens
agccaaaguaauuuccaccuaga

SEQ ID NO: 1774 - RNA, 23 nt, Homo sapiens
gccaaaguaauuuccaccuagaa

SEQ ID NO: 1775 - RNA, 23 nt, Homo sapiens
ccaaaguaauuuccaccuagaaa

SEQ ID NO: 1776 - RNA, 23 nt, Homo sapiens
gagcaagaucuugucucugaaga

SEQ ID NO: 1777 - RNA, 23 nt, Homo sapiens
agagguagaagagccaagaagcc

SEQ ID NO: 1778 - RNA, 23 nt, Homo sapiens
uccuagcucugucucuucugucu

SEQ ID NO: 1779 - RNA, 23 nt, Homo sapiens
ccuagcucugucucuucugucuc

SEQ ID NO: 1780 - RNA, 23 nt, Homo sapiens
cuagcucugucucuucugucucu

SEQ ID NO: 1781 - RNA, 23 nt, Homo sapiens
cuaucuuugugaucuuggacugu

SEQ ID NO: 1782 - RNA, 23 nt, Homo sapiens
cccuuccugugauccauuuuacu

SEQ ID NO: 1783 - RNA, 23 nt, Homo sapiens
ccuuccugugauccauuuuacug

SEQ ID NO: 1784 - RNA, 23 nt, Homo sapiens
cuuccugugauccauuuuacugc

SEQ ID NO: 1785 - RNA, 23 nt, Homo sapiens
uuccugugauccauuuuacugca

SEQ ID NO: 1786 - RNA, 23 nt, Homo sapiens
uccugugauccauuuuacugcaa

SEQ ID NO: 1787 - RNA, 23 nt, Homo sapiens
gccuauaaauauaugaccugaaa

SEQ ID NO: 1788 - RNA, 23 nt, Homo sapiens
uaugaccugaaaacuccaguuac

SEQ ID NO: 1789 - RNA, 23 nt, Homo sapiens
augaccugaaaacuccaguuaca

SEQ ID NO: 1790 - RNA, 23 nt, Homo sapiens
uaaaggaucugcagcuaucuaag

SEQ ID NO: 1791 - RNA, 23 nt, Homo sapiens
aaaggaucugcagcuaucuaagg

SEQ ID NO: 1792 - RNA, 23 nt, Homo sapiens
cagcuaucuaaggcuugguuuuc

SEQ ID NO: 1793 - RNA, 23 nt, Homo sapiens
agcuaucuaaggcuugguuuucu

SEQ ID NO: 1794 - RNA, 23 nt, Homo sapiens
cuaucuaaggcuugguuuucuua

SEQ ID NO: 1795 - RNA, 23 nt, Homo sapiens
uaucuaaggcuugguuuucuuac

SEQ ID NO: 1796 - RNA, 23 nt, Homo sapiens
aucuaaggcuugguuuucuuacu

SEQ ID NO: 1797 - RNA, 23 nt, Homo sapiens
ucuaaggcuugguuuucuuacug

SEQ ID NO: 1798 - RNA, 23 nt, Homo sapiens
aaggcuugguuuucuuacuguca

SEQ ID NO: 1799 - RNA, 23 nt, Homo sapiens
aggcuugguuuucuuacugucau

SEQ ID NO: 1800 - RNA, 23 nt, Homo sapiens
ggcuugguuuucuuacugucaua

SEQ ID NO: 1801 - RNA, 23 nt, Homo sapiens
gcuugguuuucuuacugucauau

SEQ ID NO: 1802 - RNA, 23 nt, Homo sapiens
cuugguuuucuuacugucauaug

SEQ ID NO: 1803 - RNA, 23 nt, Homo sapiens
uugguuuucuuacugucauauga

SEQ ID NO: 1804 - RNA, 23 nt, Homo sapiens
gguuuucuuacugucauaugaua

SEQ ID NO: 1805 - RNA, 23 nt, Homo sapiens
guuuucuuacugucauaugauac

SEQ ID NO: 1806 - RNA, 23 nt, Homo sapiens
uuucuuacugucauaugauaccu

SEQ ID NO: 1807 - RNA, 23 nt, Homo sapiens
uucuuacugucauaugauaccug

SEQ ID NO: 1808 - RNA, 23 nt, Homo sapiens
uuucugcgguugguaaagagaac

SEQ ID NO: 1809 - RNA, 23 nt, Homo sapiens
aauggugauuuaaucccuacaug

SEQ ID NO: 1810 - RNA, 23 nt, Homo sapiens
auggugauuuaaucccuacaugg

SEQ ID NO: 1811 - RNA, 23 nt, Homo sapiens
acuguauaaauccaaccuucugc

SEQ ID NO: 1812 - RNA, 23 nt, Homo sapiens
uggugcuugaugucacuaauaaa

SEQ ID NO: 1813 - RNA, 23 nt, Homo sapiens
ggugcuugaugucacuaauaaau

SEQ ID NO: 1814 - RNA, 23 nt, Homo sapiens
gugcuugaugucacuaauaaaug

SEQ ID NO: 1815 - RNA, 23 nt, Homo sapiens
ugaugucacuaauaaaugaaacu

SEQ ID NO: 1816 - RNA, 23 nt, Homo sapiens
gaugucacuaauaaaugaaacug

SEQ ID NO: 1817 - RNA, 23 nt, Homo sapiens
acuaauaaaugaaacugucagcu

SEQ ID NO: 1818 - RNA, 21 nt, Artificial Sequence
  source: /note="Description of Artificial Sequence: Synthetic oligonucleotide"
acagugaugcucuccaaguau

SEQ ID NO: 1819 - RNA, 21 nt, Artificial Sequence
  source: /note="Description of Artificial Sequence: Synthetic oligonucleotide"
cagugaugcucuccaaguauu

SEQ ID NO: 1820 - RNA, 21 nt, Artificial Sequence
  source: /note="Description of Artificial Sequence: Synthetic oligonucleotide"
agugaugcucuccaaguaugu

SEQ ID NO: 1821 - RNA, 21 nt, Artificial Sequence
  source: /note="Description of Artificial Sequence: Synthetic oligonucleotide"
gugaugcucuccaaguaugau

SEQ ID NO: 1822 - RNA, 21 nt, Artificial Sequence
  source: /note="Description of Artificial Sequence: Synthetic oligonucleotide"
ugaugcucuccaaguaugauu

SEQ ID NO: 1823 - RNA, 21 nt, Artificial Sequence
  source: /note="Description of Artificial Sequence: Synthetic oligonucleotide"
ucuccaaguaugaucgucugu

SEQ ID NO: 1824 - RNA, 21 nt, Artificial Sequence
  source: /note="Description of Artificial Sequence: Synthetic oligonucleotide"
cuccaaguaugaucgucugcu

SEQ ID NO: 1825 - RNA, 21 nt, Artificial Sequence
  source: /note="Description of Artificial Sequence: Synthetic oligonucleotide"
uccaaguaugaucgucugcau

SEQ ID NO: 1826 - RNA, 21 nt, Artificial Sequence
  source: /note="Description of Artificial Sequence: Synthetic oligonucleotide"
ccaaguaugaucgucugcagu

SEQ ID NO: 1827 - RNA, 21 nt, Artificial Sequence
  source: /note="Description of Artificial Sequence: Synthetic oligonucleotide"
caaguaugaucgucugcagau

SEQ ID NO: 1828 - RNA, 21 nt, Artificial Sequence
  source: /note="Description of Artificial Sequence: Synthetic oligonucleotide"
aaguaugaucgucugcagaau

SEQ ID NO: 1829 - RNA, 21 nt, Artificial Sequence
  source: /note="Description of Artificial Sequence: Synthetic oligonucleotide"
aguaugaucgucugcagaacu

SEQ ID NO: 1830 - RNA, 21 nt, Artificial Sequence
  source: /note="Description of Artificial Sequence: Synthetic oligonucleotide"
guaugaucgucugcagaacau

SEQ ID NO: 1831 - RNA, 21 nt, Artificial Sequence
  source: /note="Description of Artificial Sequence: Synthetic oligonucleotide"
uaugaucgucugcagaacaau

SEQ ID NO: 1832 - RNA, 21 nt, Artificial Sequence
  source: /note="Description of Artificial Sequence: Synthetic oligonucleotide"
augaucgucugcagaacaagu

SEQ ID NO: 1833 - RNA, 21 nt, Artificial Sequence
  source: /note="Description of Artificial Sequence: Synthetic oligonucleotide"
uauuucucagcauucaagcau

SEQ ID NO: 1834 - RNA, 21 nt, Artificial Sequence
  source: /note="Description of Artificial Sequence: Synthetic oligonucleotide"
auuucucagcauucaagcagu

SEQ ID NO: 1835 - RNA, 21 nt, Artificial Sequence
  source: /note="Description of Artificial Sequence: Synthetic oligonucleotide"
uuucucagcauucaagcaggu

SEQ ID NO: 1836 - RNA, 21 nt, Artificial Sequence
  source: /note="Description of Artificial Sequence: Synthetic oligonucleotide"
uucucagcauucaagcaggcu

SEQ ID NO: 1837 - RNA, 21 nt, Artificial Sequence
  source: /note="Description of Artificial Sequence: Synthetic oligonucleotide"
ucucagcauucaagcaggccu

SEQ ID NO: 1838 - RNA, 21 nt, Artificial Sequence
  source: /note="Description of Artificial Sequence: Synthetic oligonucleotide"
cucagcauucaagcaggccuu

SEQ ID NO: 1839 - RNA, 21 nt, Artificial Sequence
  source: /note="Description of Artificial Sequence: Synthetic oligonucleotide"
ucagcauucaagcaggccucu

SEQ ID NO: 1840 - RNA, 21 nt, Artificial Sequence
  source: /note="Description of Artificial Sequence: Synthetic oligonucleotide"
cagcauucaagcaggccuccu

SEQ ID NO: 1841 - RNA, 21 nt, Artificial Sequence
  source: /note="Description of Artificial Sequence: Synthetic oligonucleotide"
aagaagguuccaggguuuguu

SEQ ID NO: 1842 - RNA, 21 nt, Artificial Sequence
  source: /note="Description of Artificial Sequence: Synthetic oligonucleotide"
agaagguuccaggguuuguuu

SEQ ID NO: 1843 - RNA, 21 nt, Artificial Sequence
  source: /note="Description of Artificial Sequence: Synthetic oligonucleotide"
gaagguuccaggguuuguuuu

SEQ ID NO: 1844 - RNA, 21 nt, Artificial Sequence
  source: /note="Description of Artificial Sequence: Synthetic oligonucleotide"
aagguuccaggguuuguuugu

SEQ ID NO: 1845 - RNA, 21 nt, Artificial Sequence
  source: /note="Description of Artificial Sequence: Synthetic oligonucleotide"
agguuccaggguuuguuuguu

SEQ ID NO: 1846 - RNA, 21 nt, Artificial Sequence
  source: /note="Description of Artificial Sequence: Synthetic oligonucleotide"
gguuccaggguuuguuuguuu

SEQ ID NO: 1847 - RNA, 21 nt, Artificial Sequence
  source: /note="Description of Artificial Sequence: Synthetic oligonucleotide"
guuccaggguuuguuuguuuu

SEQ ID NO: 1848 - RNA, 21 nt, Artificial Sequence
  source: /note="Description of Artificial Sequence: Synthetic oligonucleotide"
uccaggguuuguuuguuucau

SEQ ID NO: 1849 - RNA, 21 nt, Artificial Sequence
  source: /note="Description of Artificial Sequence: Synthetic oligonucleotide"
ccaggguuuguuuguuucauu

SEQ ID NO: 1850 - RNA, 21 nt, Artificial Sequence
  source: /note="Description of Artificial Sequence: Synthetic oligonucleotide"
guuuguuuguuucauuuccgu

SEQ ID NO: 1851 - RNA, 21 nt, Artificial Sequence
  source: /note="Description of Artificial Sequence: Synthetic oligonucleotide"
uuuguuuguuucauuuccgcu

SEQ ID NO: 1852 - RNA, 21 nt, Artificial Sequence
  source: /note="Description of Artificial Sequence: Synthetic oligonucleotide"
uguuuguuucauuuccgcugu

SEQ ID NO: 1853 - RNA, 21 nt, Artificial Sequence
  source: /note="Description of Artificial Sequence: Synthetic oligonucleotide"
guuuguuucauuuccgcugau

SEQ ID NO: 1854 - RNA, 21 nt, Artificial Sequence
  source: /note="Description of Artificial Sequence: Synthetic oligonucleotide"
uuuguuucauuuccgcugauu

SEQ ID NO: 1855 - RNA, 21 nt, Artificial Sequence
  source: /note="Description of Artificial Sequence: Synthetic oligonucleotide"
uuguuucauuuccgcugaugu

SEQ ID NO: 1856 - RNA, 21 nt, Artificial Sequence
  source: /note="Description of Artificial Sequence: Synthetic oligonucleotide"
uguuucauuuccgcugaugau

SEQ ID NO: 1857 - RNA, 21 nt, Artificial Sequence
  source: /note="Description of Artificial Sequence: Synthetic oligonucleotide"
guuucauuuccgcugaugauu

SEQ ID NO: 1858 - RNA, 21 nt, Artificial Sequence
  source: /note="Description of Artificial Sequence: Synthetic oligonucleotide"
uuucauuuccgcugaugaugu

SEQ ID NO: 1859 - RNA, 21 nt, Artificial Sequence
  source: /note="Description of Artificial Sequence: Synthetic oligonucleotide"
ggagauggagcucuuuguguu

SEQ ID NO: 1860 - RNA, 21 nt, Artificial Sequence
  source: /note="Description of Artificial Sequence: Synthetic oligonucleotide"
gagauggagcucuuugugucu

SEQ ID NO: 1861 - RNA, 21 nt, Artificial Sequence
  source: /note="Description of Artificial Sequence: Synthetic oligonucleotide"
agauggagcucuuugugucuu

SEQ ID NO: 1862 - RNA, 21 nt, Artificial Sequence
  source: /note="Description of Artificial Sequence: Synthetic oligonucleotide"
gauggagcucuuugugucuau

SEQ ID NO: 1863 - RNA, 21 nt, Artificial Sequence
  source: /note="Description of Artificial Sequence: Synthetic oligonucleotide"
auggagcucuuugugucuacu

SEQ ID NO: 1864 - RNA, 21 nt, Artificial Sequence
  source: /note="Description of Artificial Sequence: Synthetic oligonucleotide"
uggagcucuuugugucuacau

SEQ ID NO: 1865 - RNA, 21 nt, Artificial Sequence
  source: /note="Description of Artificial Sequence: Synthetic oligonucleotide"
ggagcucuuugugucuacacu

SEQ ID NO: 1866 - RNA, 21 nt, Artificial Sequence
  source: /note="Description of Artificial Sequence: Synthetic oligonucleotide"
gagcucuuugugucuacacau

SEQ ID NO: 1867 - RNA, 21 nt, Artificial Sequence
  source: /note="Description of Artificial Sequence: Synthetic oligonucleotide"
uugugucuacacagaacaccu

SEQ ID NO: 1868 - RNA, 21 nt, Artificial Sequence
  source: /note="Description of Artificial Sequence: Synthetic oligonucleotide"
ugugucuacacagaacaccau

SEQ ID NO: 1869 - RNA, 21 nt, Artificial Sequence
  source: /note="Description of Artificial Sequence: Synthetic oligonucleotide"
gugucuacacagaacaccauu

SEQ ID NO: 1870 - RNA, 21 nt, Artificial Sequence
  source: /note="Description of Artificial Sequence: Synthetic oligonucleotide"
ugucuacacagaacaccaugu

SEQ ID NO: 1871 - RNA, 21 nt, Artificial Sequence
  source: /note="Description of Artificial Sequence: Synthetic oligonucleotide"
gucuacacagaacaccaugau

SEQ ID NO: 1872 - RNA, 21 nt, Artificial Sequence
  source: /note="Description of Artificial Sequence: Synthetic oligonucleotide"
ucuacacagaacaccaugaau

SEQ ID NO: 1873 - RNA, 21 nt, Artificial Sequence
  source: /note="Description of Artificial Sequence: Synthetic oligonucleotide"
cuacacagaacaccaugaagu

SEQ ID NO: 1874 - RNA, 21 nt, Artificial Sequence
  source: /note="Description of Artificial Sequence: Synthetic oligonucleotide"
uacacagaacaccaugaagau

SEQ ID NO: 1875 - RNA, 21 nt, Artificial Sequence
  source: /note="Description of Artificial Sequence: Synthetic oligonucleotide"
gggaacacccaggaucucucu

SEQ ID NO: 1876 - RNA, 21 nt, Artificial Sequence
  source: /note="Description of Artificial Sequence: Synthetic oligonucleotide"
ggaacacccaggaucucucuu

SEQ ID NO: 1877 - RNA, 21 nt, Artificial Sequence
  source: /note="Description of Artificial Sequence: Synthetic oligonucleotide"
gaacacccaggaucucucucu

SEQ ID NO: 1878 - RNA, 21 nt, Artificial Sequence
  source: /note="Description of Artificial Sequence: Synthetic oligonucleotide"
aacacccaggaucucucucau

SEQ ID NO: 1879 - RNA, 21 nt, Artificial Sequence
  source: /note="Description of Artificial Sequence: Synthetic oligonucleotide"
acacccaggaucucucucagu

SEQ ID NO: 1880 - RNA, 21 nt, Artificial Sequence
  source: /note="Description of Artificial Sequence: Synthetic oligonucleotide"
cacccaggaucucucucagau

SEQ ID NO: 1881 - RNA, 21 nt, Artificial Sequence
  source: /note="Description of Artificial Sequence: Synthetic oligonucleotide"
acccaggaucucucucagagu

SEQ ID NO: 1882 - RNA, 21 nt, Artificial Sequence
  source: /note="Description of Artificial Sequence: Synthetic oligonucleotide"
cccaggaucucucucagaguu

SEQ ID NO: 1883 - RNA, 21 nt, Artificial Sequence
  source: /note="Description of Artificial Sequence: Synthetic oligonucleotide"
ccaggaucucucucagaguau

SEQ ID NO: 1884 - RNA, 21 nt, Artificial Sequence
  source: /note="Description of Artificial Sequence: Synthetic oligonucleotide"
caggaucucucucagaguauu

SEQ ID NO: 1885 - RNA, 21 nt, Artificial Sequence
  source: /note="Description of Artificial Sequence: Synthetic oligonucleotide"
cucagaguauuauggaacgau

SEQ ID NO: 1886 - RNA, 21 nt, Artificial Sequence
  source: /note="Description of Artificial Sequence: Synthetic oligonucleotide"
agaguauuauggaacgagcuu

SEQ ID NO: 1887 - RNA, 21 nt, Artificial Sequence
  source: /note="Description of Artificial Sequence: Synthetic oligonucleotide"
gaguauuauggaacgagcuuu

SEQ ID NO: 1888 - RNA, 21 nt, Artificial Sequence
  source: /note="Description of Artificial Sequence: Synthetic oligonucleotide"
aguauuauggaacgagcuuuu

SEQ ID NO: 1889 - RNA, 21 nt, Artificial Sequence
  source: /note="Description of Artificial Sequence: Synthetic oligonucleotide"
guauuauggaacgagcuuuau

SEQ ID NO: 1890 - RNA, 21 nt, Artificial Sequence
  source: /note="Description of Artificial Sequence: Synthetic oligonucleotide"
uauuauggaacgagcuuuauu

SEQ ID NO: 1891 - RNA, 21 nt, Artificial Sequence
  source: /note="Description of Artificial Sequence: Synthetic oligonucleotide"
auuauggaacgagcuuuauuu

SEQ ID NO: 1892 - RNA, 21 nt, Artificial Sequence
  source: /note="Description of Artificial Sequence: Synthetic oligonucleotide"
uuauggaacgagcuuuauucu

SEQ ID NO: 1893 - RNA, 21 nt, Artificial Sequence
  source: /note="Description of Artificial Sequence: Synthetic oligonucleotide"
uauggaacgagcuuuauuccu

SEQ ID NO: 1894 - RNA, 21 nt, Artificial Sequence
  source: /note="Description of Artificial Sequence: Synthetic oligonucleotide"
cucuuccuggcugcuucuauu

SEQ ID NO: 1895 - RNA, 21 nt, Artificial Sequence
  source: /note="Description of Artificial Sequence: Synthetic oligonucleotide"
ucuuccuggcugcuucuaucu

SEQ ID NO: 1896 - RNA, 21 nt, Artificial Sequence
  source: /note="Description of Artificial Sequence: Synthetic oligonucleotide"
cuuccuggcugcuucuaucuu

SEQ ID NO: 1897 - RNA, 21 nt, Artificial Sequence
  source: /note="Description of Artificial Sequence: Synthetic oligonucleotide"
ggcugcuucuaucuucuuugu

SEQ ID NO: 1898 - RNA, 21 nt, Artificial Sequence
  source: /note="Description of Artificial Sequence: Synthetic oligonucleotide"
ucuucuuugccaucaaagauu

SEQ ID NO: 1899 - RNA, 21 nt, Artificial Sequence
  source: /note="Description of Artificial Sequence: Synthetic oligonucleotide"
uucuuugccaucaaagaugcu

SEQ ID NO: 1900 - RNA, 21 nt, Artificial Sequence
  source: /note="Description of Artificial Sequence: Synthetic oligonucleotide"
ucuuugccaucaaagaugccu

SEQ ID NO: 1901 - RNA, 21 nt, Artificial Sequence
  source: /note="Description of Artificial Sequence: Synthetic oligonucleotide"
cuuugccaucaaagaugccau

SEQ ID NO: 1902 - RNA, 21 nt, Artificial Sequence
  source: /note="Description of Artificial Sequence: Synthetic oligonucleotide"
uuugccaucaaagaugccauu

SEQ ID NO: 1903 - RNA, 21 nt, Artificial Sequence
  source: /note="Description of Artificial Sequence: Synthetic oligonucleotide"
uugccaucaaagaugccaucu

SEQ ID NO: 1904 - RNA, 21 nt, Artificial Sequence
  source: /note="Description of Artificial Sequence: Synthetic oligonucleotide"
ugccaucaaagaugccauccu

SEQ ID NO: 1905 - RNA, 21 nt, Artificial Sequence
  source: /note="Description of Artificial Sequence: Synthetic oligonucleotide"
gccaucaaagaugccauccgu

SEQ ID NO: 1906 - RNA, 21 nt, Artificial Sequence
  source: /note="Description of Artificial Sequence: Synthetic oligonucleotide"
aaaccaaugaacagcaaagcu

SEQ ID NO: 1907 - RNA, 21 nt, Artificial Sequence
  source: /note="Description of Artificial Sequence: Synthetic oligonucleotide"
aaccaaugaacagcaaagcau

SEQ ID NO: 1908 - RNA, 21 nt, Artificial Sequence
  source: /note="Description of Artificial Sequence: Synthetic oligonucleotide"
accaaugaacagcaaagcauu

SEQ ID NO: 1909 - RNA, 21 nt, Artificial Sequence
  source: /note="Description of Artificial Sequence: Synthetic oligonucleotide"
ccaaugaacagcaaagcauau

SEQ ID NO: 1910 - RNA, 21 nt, Artificial Sequence
  source: /note="Description of Artificial Sequence: Synthetic oligonucleotide"
caaugaacagcaaagcauaau

SEQ ID NO: 1911 - RNA, 21 nt, Artificial Sequence
  source: /note="Description of Artificial Sequence: Synthetic oligonucleotide"
aaugaacagcaaagcauaacu

SEQ ID NO: 1912 - RNA, 21 nt, Artificial Sequence
  source: /note="Description of Artificial Sequence: Synthetic oligonucleotide"
augaacagcaaagcauaaccu

SEQ ID NO: 1913 - RNA, 21 nt, Artificial Sequence
  source: /note="Description of Artificial Sequence: Synthetic oligonucleotide"
ugaacagcaaagcauaaccuu

SEQ ID NO: 1914 - RNA, 21 nt, Artificial Sequence
  source: /note="Description of Artificial Sequence: Synthetic oligonucleotide"
acagcaaagcauaaccuugau

SEQ ID NO: 1915 - RNA, 21 nt, Artificial Sequence
  source: /note="Description of Artificial Sequence: Synthetic oligonucleotide"
cagcaaagcauaaccuugaau

SEQ ID NO: 1916 - RNA, 21 nt, Artificial Sequence
  source: /note="Description of Artificial Sequence: Synthetic oligonucleotide"
aaagcauaaccuugaaucuau

SEQ ID NO: 1917 - RNA, 21 nt, Artificial Sequence
  source: /note="Description of Artificial Sequence: Synthetic oligonucleotide"
aagcauaaccuugaaucuauu

SEQ ID NO: 1918 - RNA, 21 nt, Artificial Sequence
  source: /note="Description of Artificial Sequence: Synthetic oligonucleotide"
agcauaaccuugaaucuauau

SEQ ID NO: 1919 - RNA, 21 nt, Artificial Sequence
  source: /note="Description of Artificial Sequence: Synthetic oligonucleotide"
cuugaaucuauacucaaauuu

SEQ ID NO: 1920 - RNA, 21 nt, Artificial Sequence
  source: /note="Description of Artificial Sequence: Synthetic oligonucleotide"
uugaaucuauacucaaauuuu

SEQ ID NO: 1921 - RNA, 21 nt, Artificial Sequence
  source: /note="Description of Artificial Sequence: Synthetic oligonucleotide"
gaaucuauacucaaauuuugu

SEQ ID NO: 1922 - RNA, 21 nt, Artificial Sequence
  source: /note="Description of Artificial Sequence: Synthetic oligonucleotide"
ucuauacucaaauuuugcaau

SEQ ID NO: 1923 - RNA, 21 nt, Artificial Sequence
  source: /note="Description of Artificial Sequence: Synthetic oligonucleotide"
cuauacucaaauuuugcaauu

SEQ ID NO: 1924 - RNA, 21 nt, Artificial Sequence
  source: /note="Description of Artificial Sequence: Synthetic oligonucleotide"
uauacucaaauuuugcaaugu

SEQ ID NO: 1925 - RNA, 21 nt, Artificial Sequence
  source: /note="Description of Artificial Sequence: Synthetic oligonucleotide"
auacucaaauuuugcaaugau

SEQ ID NO: 1926 - RNA, 21 nt, Artificial Sequence
  source: /note="Description of Artificial Sequence: Synthetic oligonucleotide"
uacucaaauuuugcaaugagu

SEQ ID NO: 1927 - RNA, 21 nt, Artificial Sequence
  source: /note="Description of Artificial Sequence: Synthetic oligonucleotide"
acucaaauuuugcaaugaggu

SEQ ID NO: 1928 - RNA, 21 nt, Artificial Sequence
  source: /note="Description of Artificial Sequence: Synthetic oligonucleotide"
cucaaauuuugcaaugaggcu

SEQ ID NO: 1929 - RNA, 21 nt, Artificial Sequence
  source: /note="Description of Artificial Sequence: Synthetic oligonucleotide"
ucaaauuuugcaaugaggcau

SEQ ID NO: 1930 - RNA, 21 nt, Artificial Sequence
  source: /note="Description of Artificial Sequence: Synthetic oligonucleotide"
caaauuuugcaaugaggcagu

SEQ ID NO: 1931 - RNA, 21 nt, Artificial Sequence
  source: /note="Description of Artificial Sequence: Synthetic oligonucleotide"
aaauuuugcaaugaggcaguu

SEQ ID NO: 1932 - RNA, 21 nt, Artificial Sequence
  source: /note="Description of Artificial Sequence: Synthetic oligonucleotide"
aauuuugcaaugaggcagugu

SEQ ID NO: 1933 - RNA, 21 nt, Artificial Sequence
  source: /note="Description of Artificial Sequence: Synthetic oligonucleotide"
auuuugcaaugaggcaguggu

SEQ ID NO: 1934 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auactuggagagcaucacugugc

SEQ ID NO: 1935 - RNA, 23 nt, Artificial Sequence
  source: /note="Description of Artificial Sequence: Synthetic oligonucleotide"
aauacuuggagagcaucacugug

SEQ ID NO: 1936 - RNA, 23 nt, Artificial Sequence
  source: /note="Description of Artificial Sequence: Synthetic oligonucleotide"
acauacuuggagagcaucacugu

SEQ ID NO: 1937 - RNA, 23 nt, Artificial Sequence
  source: /note="Description of Artificial Sequence: Synthetic oligonucleotide"
aucauacuuggagagcaucacug

SEQ ID NO: 1938 - RNA, 23 nt, Artificial Sequence
  source: /note="Description of Artificial Sequence: Synthetic oligonucleotide"
aaucauacuuggagagcaucacu

SEQ ID NO: 1939 - RNA, 23 nt, Artificial Sequence
  source: /note="Description of Artificial Sequence: Synthetic oligonucleotide"
acagacgaucauacuuggagagc

SEQ ID NO: 1940 - RNA, 23 nt, Artificial Sequence
  source: /note="Description of Artificial Sequence: Synthetic oligonucleotide"
agcagacgaucauacuuggagag

SEQ ID NO: 1941 - RNA, 23 nt, Artificial Sequence
  source: /note="Description of Artificial Sequence: Synthetic oligonucleotide"
augcagacgaucauacuuggaga

SEQ ID NO: 1942 - RNA, 23 nt, Artificial Sequence
  source: /note="Description of Artificial Sequence: Synthetic oligonucleotide"
acugcagacgaucauacuuggag

SEQ ID NO: 1943 - RNA, 23 nt, Artificial Sequence
  source: /note="Description of Artificial Sequence: Synthetic oligonucleotide"
aucugcagacgaucauacuugga

SEQ ID NO: 1944 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgcagacgaucauacuugg

SEQ ID NO: 1945 - RNA, 23 nt, Artificial Sequence
  source: /note="Description of Artificial Sequence: Synthetic oligonucleotide"
aguucugcagacgaucauacuug

SEQ ID NO: 1946 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutctgcagacgaucauacuu

SEQ ID NO: 1947 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugtucugcagacgaucauacu

SEQ ID NO: 1948 - RNA, 23 nt, Artificial Sequence
  source: /note="Description of Artificial Sequence: Synthetic oligonucleotide"
acuuguucugcagacgaucauac

SEQ ID NO: 1949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctugaaugcugagaaauacu

SEQ ID NO: 1950 - RNA, 23 nt, Artificial Sequence
  source: /note="Description of Artificial Sequence: Synthetic oligonucleotide"
acugcuugaaugcugagaaauac

SEQ ID NO: 1951 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugctugaaugcugagaaaua

SEQ ID NO: 1952 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctgcuugaaugcugagaaau

SEQ ID NO: 1953 - RNA, 23 nt, Artificial Sequence
  source: /note="Description of Artificial Sequence: Synthetic oligonucleotide"
aggccugcuugaaugcugagaaa

SEQ ID NO: 1954 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggcctgcuugaaugcugagaa

SEQ ID NO: 1955 - RNA, 23 nt, Artificial Sequence
  source: /note="Description of Artificial Sequence: Synthetic oligonucleotide"
agaggccugcuugaaugcugaga

SEQ ID NO: 1956 - RNA, 23 nt, Artificial Sequence
  source: /note="Description of Artificial Sequence: Synthetic oligonucleotide"
aggaggccugcuugaaugcugag

SEQ ID NO: 1957 - RNA, 23 nt, Artificial Sequence
  source: /note="Description of Artificial Sequence: Synthetic oligonucleotide"
aacaaacccuggaaccuucuuag

SEQ ID NO: 1958 - RNA, 23 nt, Artificial Sequence
  source: /note="Description of Artificial Sequence: Synthetic oligonucleotide"
aaacaaacccuggaaccuucuua

SEQ ID NO: 1959 - RNA, 23 nt, Artificial Sequence
  source: /note="Description of Artificial Sequence: Synthetic oligonucleotide"
aaaacaaacccuggaaccuucuu

SEQ ID NO: 1960 - RNA, 23 nt, Artificial Sequence
  source: /note="Description of Artificial Sequence: Synthetic oligonucleotide"
acaaacaaacccuggaaccuucu

SEQ ID NO: 1961 - RNA, 23 nt, Artificial Sequence
  source: /note="Description of Artificial Sequence: Synthetic oligonucleotide"
aacaaacaaacccuggaaccuuc

SEQ ID NO: 1962 - RNA, 23 nt, Artificial Sequence
  source: /note="Description of Artificial Sequence: Synthetic oligonucleotide"
aaacaaacaaacccuggaaccuu

SEQ ID NO: 1963 - RNA, 23 nt, Artificial Sequence
  source: /note="Description of Artificial Sequence: Synthetic oligonucleotide"
aaaacaaacaaacccuggaaccu

SEQ ID NO: 1964 - RNA, 23 nt, Artificial Sequence
  source: /note="Description of Artificial Sequence: Synthetic oligonucleotide"
augaaacaaacaaacccuggaac

SEQ ID NO: 1965 - RNA, 23 nt, Artificial Sequence
  source: /note="Description of Artificial Sequence: Synthetic oligonucleotide"
aaugaaacaaacaaacccuggaa

SEQ ID NO: 1966 - RNA, 23 nt, Artificial Sequence
  source: /note="Description of Artificial Sequence: Synthetic oligonucleotide"
acggaaaugaaacaaacaaaccc

SEQ ID NO: 1967 - RNA, 23 nt, Artificial Sequence
  source: /note="Description of Artificial Sequence: Synthetic oligonucleotide"
agcggaaaugaaacaaacaaacc

SEQ ID NO: 1968 - RNA, 23 nt, Artificial Sequence
  source: /note="Description of Artificial Sequence: Synthetic oligonucleotide"
acagcggaaaugaaacaaacaaa

SEQ ID NO: 1969 - RNA, 23 nt, Artificial Sequence
  source: /note="Description of Artificial Sequence: Synthetic oligonucleotide"
aucagcggaaaugaaacaaacaa

SEQ ID NO: 1970 - RNA, 23 nt, Artificial Sequence
  source: /note="Description of Artificial Sequence: Synthetic oligonucleotide"
aaucagcggaaaugaaacaaaca

SEQ ID NO: 1971 - RNA, 23 nt, Artificial Sequence
  source: /note="Description of Artificial Sequence: Synthetic oligonucleotide"
acaucagcggaaaugaaacaaac

SEQ ID NO: 1972 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatcagcggaaaugaaacaaa

SEQ ID NO: 1973 - RNA, 23 nt, Artificial Sequence
  source: /note="Description of Artificial Sequence: Synthetic oligonucleotide"
aaucaucagcggaaaugaaacaa

SEQ ID NO: 1974 - RNA, 23 nt, Artificial Sequence
  source: /note="Description of Artificial Sequence: Synthetic oligonucleotide"
acaucaucagcggaaaugaaaca

SEQ ID NO: 1975 - RNA, 23 nt, Artificial Sequence
  source: /note="Description of Artificial Sequence: Synthetic oligonucleotide"
aacacaaagagcuccaucucccc

SEQ ID NO: 1976 - RNA, 23 nt, Artificial Sequence
  source: /note="Description of Artificial Sequence: Synthetic oligonucleotide"
agacacaaagagcuccaucuccc

SEQ ID NO: 1977 - RNA, 23 nt, Artificial Sequence
  source: /note="Description of Artificial Sequence: Synthetic oligonucleotide"
aagacacaaagagcuccaucucc

SEQ ID NO: 1978 - RNA, 23 nt, Artificial Sequence
  source: /note="Description of Artificial Sequence: Synthetic oligonucleotide"
auagacacaaagagcuccaucuc

SEQ ID NO: 1979 - RNA, 23 nt, Artificial Sequence
  source: /note="Description of Artificial Sequence: Synthetic oligonucleotide"
aguagacacaaagagcuccaucu

SEQ ID NO: 1980 - RNA, 23 nt, Artificial Sequence
  source: /note="Description of Artificial Sequence: Synthetic oligonucleotide"
auguagacacaaagagcuccauc

SEQ ID NO: 1981 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtagacacaaagagcuccau

SEQ ID NO: 1982 - RNA, 23 nt, Artificial Sequence
  source: /note="Description of Artificial Sequence: Synthetic oligonucleotide"
auguguagacacaaagagcucca

SEQ ID NO: 1983 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggugutcuguguagacacaaag

SEQ ID NO: 1984 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggtgtucuguguagacacaaa

SEQ ID NO: 1985 - RNA, 23 nt, Artificial Sequence
  source: /note="Description of Artificial Sequence: Synthetic oligonucleotide"
aaugguguucuguguagacacaa

SEQ ID NO: 1986 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauggtguucuguguagacaca

SEQ ID NO: 1987 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatgguguucuguguagacac

SEQ ID NO: 1988 - RNA, 23 nt, Artificial Sequence
  source: /note="Description of Artificial Sequence: Synthetic oligonucleotide"
auucaugguguucuguguagaca

SEQ ID NO: 1989 - RNA, 23 nt, Artificial Sequence
  source: /note="Description of Artificial Sequence: Synthetic oligonucleotide"
acuucaugguguucuguguagac

SEQ ID NO: 1990 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutcaugguguucuguguaga

SEQ ID NO: 1991 - RNA, 23 nt, Artificial Sequence
  source: /note="Description of Artificial Sequence: Synthetic oligonucleotide"
agagagauccuggguguucccca

SEQ ID NO: 1992 - RNA, 23 nt, Artificial Sequence
  source: /note="Description of Artificial Sequence: Synthetic oligonucleotide"
aagagagauccuggguguucccc

SEQ ID NO: 1993 - RNA, 23 nt, Artificial Sequence
  source: /note="Description of Artificial Sequence: Synthetic oligonucleotide"
agagagagauccuggguguuccc

SEQ ID NO: 1994 - RNA, 23 nt, Artificial Sequence
  source: /note="Description of Artificial Sequence: Synthetic oligonucleotide"
augagagagauccuggguguucc

SEQ ID NO: 1995 - RNA, 23 nt, Artificial Sequence
  source: /note="Description of Artificial Sequence: Synthetic oligonucleotide"
acugagagagauccuggguguuc

SEQ ID NO: 1996 - RNA, 23 nt, Artificial Sequence
  source: /note="Description of Artificial Sequence: Synthetic oligonucleotide"
aucugagagagauccuggguguu

SEQ ID NO: 1997 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuctgagagagauccugggugu

SEQ ID NO: 1998 - RNA, 23 nt, Artificial Sequence
  source: /note="Description of Artificial Sequence: Synthetic oligonucleotide"
aacucugagagagauccugggug

SEQ ID NO: 1999 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auactctgagagagauccugggu

SEQ ID NO: 2000 - RNA, 23 nt, Artificial Sequence
  source: /note="Description of Artificial Sequence: Synthetic oligonucleotide"
aauacucugagagagauccuggg

SEQ ID NO: 2001 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgtuccauaauacucugagag

SEQ ID NO: 2002 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagctcguuccauaauacucuga

SEQ ID NO: 2003 - RNA, 23 nt, Artificial Sequence
  source: /note="Description of Artificial Sequence: Synthetic oligonucleotide"
aaagcucguuccauaauacucug

SEQ ID NO: 2004 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagctcguuccauaauacucu

SEQ ID NO: 2005 - RNA, 23 nt, Artificial Sequence
  source: /note="Description of Artificial Sequence: Synthetic oligonucleotide"
auaaagcucguuccauaauacuc

SEQ ID NO: 2006 - RNA, 23 nt, Artificial Sequence
  source: /note="Description of Artificial Sequence: Synthetic oligonucleotide"
aauaaagcucguuccauaauacu

SEQ ID NO: 2007 - RNA, 23 nt, Artificial Sequence
  source: /note="Description of Artificial Sequence: Synthetic oligonucleotide"
aaauaaagcucguuccauaauac

SEQ ID NO: 2008 - RNA, 23 nt, Artificial Sequence
  source: /note="Description of Artificial Sequence: Synthetic oligonucleotide"
agaauaaagcucguuccauaaua

SEQ ID NO: 2009 - RNA, 23 nt, Artificial Sequence
  source: /note="Description of Artificial Sequence: Synthetic oligonucleotide"
aggaauaaagcucguuccauaau

SEQ ID NO: 2010 - RNA, 23 nt, Artificial Sequence
  source: /note="Description of Artificial Sequence: Synthetic oligonucleotide"
aauagaagcagccaggaagaggg

SEQ ID NO: 2011 - RNA, 23 nt, Artificial Sequence
  source: /note="Description of Artificial Sequence: Synthetic oligonucleotide"
agauagaagcagccaggaagagg

SEQ ID NO: 2012 - RNA, 23 nt, Artificial Sequence
  source: /note="Description of Artificial Sequence: Synthetic oligonucleotide"
aagauagaagcagccaggaagag

SEQ ID NO: 2013 - RNA, 23 nt, Artificial Sequence
  source: /note="Description of Artificial Sequence: Synthetic oligonucleotide"
acaaagaagauagaagcagccag

SEQ ID NO: 2014 - RNA, 23 nt, Artificial Sequence
  source: /note="Description of Artificial Sequence: Synthetic oligonucleotide"
aaucuuugauggcaaagaagaua

SEQ ID NO: 2015 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatctuugauggcaaagaaga

SEQ ID NO: 2016 - RNA, 23 nt, Artificial Sequence
  source: /note="Description of Artificial Sequence: Synthetic oligonucleotide"
aggcaucuuugauggcaaagaag

SEQ ID NO: 2017 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggcatcuuugauggcaaagaa

SEQ ID NO: 2018 - RNA, 23 nt, Artificial Sequence
  source: /note="Description of Artificial Sequence: Synthetic oligonucleotide"
aauggcaucuuugauggcaaaga

SEQ ID NO: 2019 - RNA, 23 nt, Artificial Sequence
  source: /note="Description of Artificial Sequence: Synthetic oligonucleotide"
agauggcaucuuugauggcaaag

SEQ ID NO: 2020 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggatggcaucuuugauggcaaa

SEQ ID NO: 2021 - RNA, 23 nt, Artificial Sequence
  source: /note="Description of Artificial Sequence: Synthetic oligonucleotide"
acggauggcaucuuugauggcaa

SEQ ID NO: 2022 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutugcuguucauugguuuga

SEQ ID NO: 2023 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctutgcuguucauugguuug

SEQ ID NO: 2024 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugcutugcuguucauugguuu

SEQ ID NO: 2025 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaugctuugcuguucauugguu

SEQ ID NO: 2026 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuatgcuuugcuguucauuggu

SEQ ID NO: 2027 - RNA, 23 nt, Artificial Sequence
  source: /note="Description of Artificial Sequence: Synthetic oligonucleotide"
aguuaugcuuugcuguucauugg

SEQ ID NO: 2028 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutatgcuuugcuguucauug

SEQ ID NO: 2029 - RNA, 23 nt, Artificial Sequence
  source: /note="Description of Artificial Sequence: Synthetic oligonucleotide"
aagguuaugcuuugcuguucauu

SEQ ID NO: 2030 - RNA, 23 nt, Artificial Sequence
  source: /note="Description of Artificial Sequence: Synthetic oligonucleotide"
aucaagguuaugcuuugcuguuc

SEQ ID NO: 2031 - RNA, 23 nt, Artificial Sequence
  source: /note="Description of Artificial Sequence: Synthetic oligonucleotide"
auucaagguuaugcuuugcuguu

SEQ ID NO: 2032 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagautcaagguuaugcuuugc

SEQ ID NO: 2033 - RNA, 23 nt, Artificial Sequence
  source: /note="Description of Artificial Sequence: Synthetic oligonucleotide"
aauagauucaagguuaugcuuug

SEQ ID NO: 2034 - RNA, 23 nt, Artificial Sequence
  source: /note="Description of Artificial Sequence: Synthetic oligonucleotide"
auauagauucaagguuaugcuuu

SEQ ID NO: 2035 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautugaguauagauucaaggu

SEQ ID NO: 2036 - RNA, 23 nt, Artificial Sequence
  source: /note="Description of Artificial Sequence: Synthetic oligonucleotide"
aaaauuugaguauagauucaagg

SEQ ID NO: 2037 - RNA, 23 nt, Artificial Sequence
  source: /note="Description of Artificial Sequence: Synthetic oligonucleotide"
acaaaauuugaguauagauucaa

SEQ ID NO: 2038 - RNA, 23 nt, Artificial Sequence
  source: /note="Description of Artificial Sequence: Synthetic oligonucleotide"
auugcaaaauuugaguauagauu

SEQ ID NO: 2039 - RNA, 23 nt, Artificial Sequence
  source: /note="Description of Artificial Sequence: Synthetic oligonucleotide"
aauugcaaaauuugaguauagau

SEQ ID NO: 2040 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acautgcaaaauuugaguauaga

SEQ ID NO: 2041 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatugcaaaauuugaguauag

SEQ ID NO: 2042 - RNA, 23 nt, Artificial Sequence
  source: /note="Description of Artificial Sequence: Synthetic oligonucleotide"
acucauugcaaaauuugaguaua

SEQ ID NO: 2043 - RNA, 23 nt, Artificial Sequence
  source: /note="Description of Artificial Sequence: Synthetic oligonucleotide"
accucauugcaaaauuugaguau

SEQ ID NO: 2044 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctcauugcaaaauuugagua

SEQ ID NO: 2045 - RNA, 23 nt, Artificial Sequence
  source: /note="Description of Artificial Sequence: Synthetic oligonucleotide"
augccucauugcaaaauuugagu

SEQ ID NO: 2046 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugcctcauugcaaaauuugag

SEQ ID NO: 2047 - RNA, 23 nt, Artificial Sequence
  source: /note="Description of Artificial Sequence: Synthetic oligonucleotide"
aacugccucauugcaaaauuuga

SEQ ID NO: 2048 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acactgccucauugcaaaauuug

SEQ ID NO: 2049 - RNA, 23 nt, Artificial Sequence
  source: /note="Description of Artificial Sequence: Synthetic oligonucleotide"
accacugccucauugcaaaauuu

SEQ ID NO: 2050 - RNA, 23 nt, Artificial Sequence
  source: /note="Description of Artificial Sequence: Synthetic oligonucleotide"
aagacgaucauacuuggagagcg

SEQ ID NO: 2051 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauacutggagagcaucacugug

SEQ ID NO: 2052 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugcagacgatcauacuuggag

SEQ ID NO: 2053 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcagcggaaatgaaacaaacgg

SEQ ID NO: 2054 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgagagagauccuggguguucc

SEQ ID NO: 2055 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaatgcugagaaauacuccc

SEQ ID NO: 2056 - RNA, 21 nt, Artificial Sequence
  source: /note="Description of Artificial Sequence: Synthetic oligonucleotide"
acagugaugcucuccaaguau

SEQ ID NO: 2057 - RNA, 21 nt, Artificial Sequence
  source: /note="Description of Artificial Sequence: Synthetic oligonucleotide"
cagugaugcucuccaaguauu

SEQ ID NO: 2058 - RNA, 21 nt, Artificial Sequence
  source: /note="Description of Artificial Sequence: Synthetic oligonucleotide"
agugaugcucuccaaguaugu

SEQ ID NO: 2059 - RNA, 21 nt, Artificial Sequence
  source: /note="Description of Artificial Sequence: Synthetic oligonucleotide"
gugaugcucuccaaguaugau

SEQ ID NO: 2060 - RNA, 21 nt, Artificial Sequence
  source: /note="Description of Artificial Sequence: Synthetic oligonucleotide"
ugaugcucuccaaguaugauu

SEQ ID NO: 2061 - RNA, 21 nt, Artificial Sequence
  source: /note="Description of Artificial Sequence: Synthetic oligonucleotide"
ucuccaaguaugaucgucugu

SEQ ID NO: 2062 - RNA, 21 nt, Artificial Sequence
  source: /note="Description of Artificial Sequence: Synthetic oligonucleotide"
cuccaaguaugaucgucugcu

SEQ ID NO: 2063 - RNA, 21 nt, Artificial Sequence
  source: /note="Description of Artificial Sequence: Synthetic oligonucleotide"
uccaaguaugaucgucugcau

SEQ ID NO: 2064 - RNA, 21 nt, Artificial Sequence
  source: /note="Description of Artificial Sequence: Synthetic oligonucleotide"
ccaaguaugaucgucugcagu

SEQ ID NO: 2065 - RNA, 21 nt, Artificial Sequence
  source: /note="Description of Artificial Sequence: Synthetic oligonucleotide"
caaguaugaucgucugcagau

SEQ ID NO: 2066 - RNA, 21 nt, Artificial Sequence
  source: /note="Description of Artificial Sequence: Synthetic oligonucleotide"
aaguaugaucgucugcagaau

SEQ ID NO: 2067 - RNA, 21 nt, Artificial Sequence
  source: /note="Description of Artificial Sequence: Synthetic oligonucleotide"
aguaugaucgucugcagaacu

SEQ ID NO: 2068 - RNA, 21 nt, Artificial Sequence
  source: /note="Description of Artificial Sequence: Synthetic oligonucleotide"
guaugaucgucugcagaacau

SEQ ID NO: 2069 - RNA, 21 nt, Artificial Sequence
  source: /note="Description of Artificial Sequence: Synthetic oligonucleotide"
uaugaucgucugcagaacaau

SEQ ID NO: 2070 - RNA, 21 nt, Artificial Sequence
  source: /note="Description of Artificial Sequence: Synthetic oligonucleotide"
augaucgucugcagaacaagu

SEQ ID NO: 2071 - RNA, 21 nt, Artificial Sequence
  source: /note="Description of Artificial Sequence: Synthetic oligonucleotide"
uauuucucagcauucaagcau

SEQ ID NO: 2072 - RNA, 21 nt, Artificial Sequence
  source: /note="Description of Artificial Sequence: Synthetic oligonucleotide"
auuucucagcauucaagcagu

SEQ ID NO: 2073 - RNA, 21 nt, Artificial Sequence
  source: /note="Description of Artificial Sequence: Synthetic oligonucleotide"
uuucucagcauucaagcaggu

SEQ ID NO: 2074 - RNA, 21 nt, Artificial Sequence
  source: /note="Description of Artificial Sequence: Synthetic oligonucleotide"
uucucagcauucaagcaggcu

SEQ ID NO: 2075 - RNA, 21 nt, Artificial Sequence
  source: /note="Description of Artificial Sequence: Synthetic oligonucleotide"
ucucagcauucaagcaggccu

SEQ ID NO: 2076 - RNA, 21 nt, Artificial Sequence
  source: /note="Description of Artificial Sequence: Synthetic oligonucleotide"
cucagcauucaagcaggccuu

SEQ ID NO: 2077 - RNA, 21 nt, Artificial Sequence
  source: /note="Description of Artificial Sequence: Synthetic oligonucleotide"
ucagcauucaagcaggccucu

SEQ ID NO: 2078 - RNA, 21 nt, Artificial Sequence
  source: /note="Description of Artificial Sequence: Synthetic oligonucleotide"
cagcauucaagcaggccuccu

SEQ ID NO: 2079 - RNA, 21 nt, Artificial Sequence
  source: /note="Description of Artificial Sequence: Synthetic oligonucleotide"
aagaagguuccaggguuuguu

SEQ ID NO: 2080 - RNA, 21 nt, Artificial Sequence
  source: /note="Description of Artificial Sequence: Synthetic oligonucleotide"
agaagguuccaggguuuguuu

SEQ ID NO: 2081 - RNA, 21 nt, Artificial Sequence
  source: /note="Description of Artificial Sequence: Synthetic oligonucleotide"
gaagguuccaggguuuguuuu

SEQ ID NO: 2082 - RNA, 21 nt, Artificial Sequence
  source: /note="Description of Artificial Sequence: Synthetic oligonucleotide"
aagguuccaggguuuguuugu

SEQ ID NO: 2083 - RNA, 21 nt, Artificial Sequence
  source: /note="Description of Artificial Sequence: Synthetic oligonucleotide"
agguuccaggguuuguuuguu

SEQ ID NO: 2084 - RNA, 21 nt, Artificial Sequence
  source: /note="Description of Artificial Sequence: Synthetic oligonucleotide"
gguuccaggguuuguuuguuu

SEQ ID NO: 2085 - RNA, 21 nt, Artificial Sequence
  source: /note="Description of Artificial Sequence: Synthetic oligonucleotide"
guuccaggguuuguuuguuuu

SEQ ID NO: 2086 - RNA, 21 nt, Artificial Sequence
  source: /note="Description of Artificial Sequence: Synthetic oligonucleotide"
uccaggguuuguuuguuucau

SEQ ID NO: 2087 - RNA, 21 nt, Artificial Sequence
  source: /note="Description of Artificial Sequence: Synthetic oligonucleotide"
ccaggguuuguuuguuucauu

SEQ ID NO: 2088 - RNA, 21 nt, Artificial Sequence
  source: /note="Description of Artificial Sequence: Synthetic oligonucleotide"
guuuguuuguuucauuuccgu

SEQ ID NO: 2089 - RNA, 21 nt, Artificial Sequence
  source: /note="Description of Artificial Sequence: Synthetic oligonucleotide"
uuuguuuguuucauuuccgcu

SEQ ID NO: 2090 - RNA, 21 nt, Artificial Sequence
  source: /note="Description of Artificial Sequence: Synthetic oligonucleotide"
uguuuguuucauuuccgcugu

SEQ ID NO: 2091 - RNA, 21 nt, Artificial Sequence
  source: /note="Description of Artificial Sequence: Synthetic oligonucleotide"
guuuguuucauuuccgcugau

SEQ ID NO: 2092 - RNA, 21 nt, Artificial Sequence
  source: /note="Description of Artificial Sequence: Synthetic oligonucleotide"
uuuguuucauuuccgcugauu

SEQ ID NO: 2093 - RNA, 21 nt, Artificial Sequence
  source: /note="Description of Artificial Sequence: Synthetic oligonucleotide"
uuguuucauuuccgcugaugu

SEQ ID NO: 2094 - RNA, 21 nt, Artificial Sequence
  source: /note="Description of Artificial Sequence: Synthetic oligonucleotide"
uguuucauuuccgcugaugau

SEQ ID NO: 2095 - RNA, 21 nt, Artificial Sequence
  source: /note="Description of Artificial Sequence: Synthetic oligonucleotide"
guuucauuuccgcugaugauu

SEQ ID NO: 2096 - RNA, 21 nt, Artificial Sequence
  source: /note="Description of Artificial Sequence: Synthetic oligonucleotide"
uuucauuuccgcugaugaugu

SEQ ID NO: 2097 - RNA, 21 nt, Artificial Sequence
  source: /note="Description of Artificial Sequence: Synthetic oligonucleotide"
ggagauggagcucuuuguguu

SEQ ID NO: 2098 - RNA, 21 nt, Artificial Sequence
  source: /note="Description of Artificial Sequence: Synthetic oligonucleotide"
gagauggagcucuuugugucu

SEQ ID NO: 2099 - RNA, 21 nt, Artificial Sequence
  source: /note="Description of Artificial Sequence: Synthetic oligonucleotide"
agauggagcucuuugugucuu

SEQ ID NO: 2100 - RNA, 21 nt, Artificial Sequence
  source: /note="Description of Artificial Sequence: Synthetic oligonucleotide"
gauggagcucuuugugucuau

SEQ ID NO: 2101 - RNA, 21 nt, Artificial Sequence
  source: /note="Description of Artificial Sequence: Synthetic oligonucleotide"
auggagcucuuugugucuacu

SEQ ID NO: 2102 - RNA, 21 nt, Artificial Sequence
  source: /note="Description of Artificial Sequence: Synthetic oligonucleotide"
uggagcucuuugugucuacau

SEQ ID NO: 2103 - RNA, 21 nt, Artificial Sequence
  source: /note="Description of Artificial Sequence: Synthetic oligonucleotide"
ggagcucuuugugucuacacu

SEQ ID NO: 2104 - RNA, 21 nt, Artificial Sequence
  source: /note="Description of Artificial Sequence: Synthetic oligonucleotide"
gagcucuuugugucuacacau

SEQ ID NO: 2105 - RNA, 21 nt, Artificial Sequence
  source: /note="Description of Artificial Sequence: Synthetic oligonucleotide"
uugugucuacacagaacaccu

SEQ ID NO: 2106 - RNA, 21 nt, Artificial Sequence
  source: /note="Description of Artificial Sequence: Synthetic oligonucleotide"
ugugucuacacagaacaccau

SEQ ID NO: 2107 - RNA, 21 nt, Artificial Sequence
  source: /note="Description of Artificial Sequence: Synthetic oligonucleotide"
gugucuacacagaacaccauu

SEQ ID NO: 2108 - RNA, 21 nt, Artificial Sequence
  source: /note="Description of Artificial Sequence: Synthetic oligonucleotide"
ugucuacacagaacaccaugu

SEQ ID NO: 2109 - RNA, 21 nt, Artificial Sequence
  source: /note="Description of Artificial Sequence: Synthetic oligonucleotide"
gucuacacagaacaccaugau

SEQ ID NO: 2110 - RNA, 21 nt, Artificial Sequence
  source: /note="Description of Artificial Sequence: Synthetic oligonucleotide"
ucuacacagaacaccaugaau

SEQ ID NO: 2111 - RNA, 21 nt, Artificial Sequence
  source: /note="Description of Artificial Sequence: Synthetic oligonucleotide"
cuacacagaacaccaugaagu

SEQ ID NO: 2112 - RNA, 21 nt, Artificial Sequence
  source: /note="Description of Artificial Sequence: Synthetic oligonucleotide"
uacacagaacaccaugaagau

SEQ ID NO: 2113 - RNA, 21 nt, Artificial Sequence
  source: /note="Description of Artificial Sequence: Synthetic oligonucleotide"
gggaacacccaggaucucucu

SEQ ID NO: 2114 - RNA, 21 nt, Artificial Sequence
  source: /note="Description of Artificial Sequence: Synthetic oligonucleotide"
ggaacacccaggaucucucuu

SEQ ID NO: 2115 - RNA, 21 nt, Artificial Sequence
  source: /note="Description of Artificial Sequence: Synthetic oligonucleotide"
gaacacccaggaucucucucu

SEQ ID NO: 2116 - RNA, 21 nt, Artificial Sequence
  source: /note="Description of Artificial Sequence: Synthetic oligonucleotide"
aacacccaggaucucucucau

SEQ ID NO: 2117 - RNA, 21 nt, Artificial Sequence
  source: /note="Description of Artificial Sequence: Synthetic oligonucleotide"
acacccaggaucucucucagu

SEQ ID NO: 2118 - RNA, 21 nt, Artificial Sequence
  source: /note="Description of Artificial Sequence: Synthetic oligonucleotide"
cacccaggaucucucucagau

SEQ ID NO: 2119 - RNA, 21 nt, Artificial Sequence
  source: /note="Description of Artificial Sequence: Synthetic oligonucleotide"
acccaggaucucucucagagu

SEQ ID NO: 2120 - RNA, 21 nt, Artificial Sequence
  source: /note="Description of Artificial Sequence: Synthetic oligonucleotide"
cccaggaucucucucagaguu

SEQ ID NO: 2121 - RNA, 21 nt, Artificial Sequence
  source: /note="Description of Artificial Sequence: Synthetic oligonucleotide"
ccaggaucucucucagaguau

SEQ ID NO: 2122 - RNA, 21 nt, Artificial Sequence
  source: /note="Description of Artificial Sequence: Synthetic oligonucleotide"
caggaucucucucagaguauu

SEQ ID NO: 2123 - RNA, 21 nt, Artificial Sequence
  source: /note="Description of Artificial Sequence: Synthetic oligonucleotide"
cucagaguauuauggaacgau

SEQ ID NO: 2124 - RNA, 21 nt, Artificial Sequence
  source: /note="Description of Artificial Sequence: Synthetic oligonucleotide"
agaguauuauggaacgagcuu

SEQ ID NO: 2125 - RNA, 21 nt, Artificial Sequence
  source: /note="Description of Artificial Sequence: Synthetic oligonucleotide"
gaguauuauggaacgagcuuu

SEQ ID NO: 2126 - RNA, 21 nt, Artificial Sequence
  source: /note="Description of Artificial Sequence: Synthetic oligonucleotide"
aguauuauggaacgagcuuuu

SEQ ID NO: 2127 - RNA, 21 nt, Artificial Sequence
  source: /note="Description of Artificial Sequence: Synthetic oligonucleotide"
guauuauggaacgagcuuuau

SEQ ID NO: 2128 - RNA, 21 nt, Artificial Sequence
  source: /note="Description of Artificial Sequence: Synthetic oligonucleotide"
uauuauggaacgagcuuuauu

SEQ ID NO: 2129 - RNA, 21 nt, Artificial Sequence
  source: /note="Description of Artificial Sequence: Synthetic oligonucleotide"
auuauggaacgagcuuuauuu

SEQ ID NO: 2130 - RNA, 21 nt, Artificial Sequence
  source: /note="Description of Artificial Sequence: Synthetic oligonucleotide"
uuauggaacgagcuuuauucu

SEQ ID NO: 2131 - RNA, 21 nt, Artificial Sequence
  source: /note="Description of Artificial Sequence: Synthetic oligonucleotide"
uauggaacgagcuuuauuccu

SEQ ID NO: 2132 - RNA, 21 nt, Artificial Sequence
  source: /note="Description of Artificial Sequence: Synthetic oligonucleotide"
cucuuccuggcugcuucuauu

SEQ ID NO: 2133 - RNA, 21 nt, Artificial Sequence
  source: /note="Description of Artificial Sequence: Synthetic oligonucleotide"
ucuuccuggcugcuucuaucu

SEQ ID NO: 2134 - RNA, 21 nt, Artificial Sequence
  source: /note="Description of Artificial Sequence: Synthetic oligonucleotide"
cuuccuggcugcuucuaucuu

SEQ ID NO: 2135 - RNA, 21 nt, Artificial Sequence
  source: /note="Description of Artificial Sequence: Synthetic oligonucleotide"
ggcugcuucuaucuucuuugu

SEQ ID NO: 2136 - RNA, 21 nt, Artificial Sequence
  source: /note="Description of Artificial Sequence: Synthetic oligonucleotide"
ucuucuuugccaucaaagauu

SEQ ID NO: 2137 - RNA, 21 nt, Artificial Sequence
  source: /note="Description of Artificial Sequence: Synthetic oligonucleotide"
uucuuugccaucaaagaugcu

SEQ ID NO: 2138 - RNA, 21 nt, Artificial Sequence
  source: /note="Description of Artificial Sequence: Synthetic oligonucleotide"
ucuuugccaucaaagaugccu

SEQ ID NO: 2139 - RNA, 21 nt, Artificial Sequence
  source: /note="Description of Artificial Sequence: Synthetic oligonucleotide"
cuuugccaucaaagaugccau

SEQ ID NO: 2140 - RNA, 21 nt, Artificial Sequence
  source: /note="Description of Artificial Sequence: Synthetic oligonucleotide"
uuugccaucaaagaugccauu

SEQ ID NO: 2141 - RNA, 21 nt, Artificial Sequence
  source: /note="Description of Artificial Sequence: Synthetic oligonucleotide"
uugccaucaaagaugccaucu

SEQ ID NO: 2142 - RNA, 21 nt, Artificial Sequence
  source: /note="Description of Artificial Sequence: Synthetic oligonucleotide"
ugccaucaaagaugccauccu

SEQ ID NO: 2143 - RNA, 21 nt, Artificial Sequence
  source: /note="Description of Artificial Sequence: Synthetic oligonucleotide"
gccaucaaagaugccauccgu

SEQ ID NO: 2144 - RNA, 21 nt, Artificial Sequence
  source: /note="Description of Artificial Sequence: Synthetic oligonucleotide"
aaaccaaugaacagcaaagcu

SEQ ID NO: 2145 - RNA, 21 nt, Artificial Sequence
  source: /note="Description of Artificial Sequence: Synthetic oligonucleotide"
aaccaaugaacagcaaagcau

SEQ ID NO: 2146 - RNA, 21 nt, Artificial Sequence
  source: /note="Description of Artificial Sequence: Synthetic oligonucleotide"
accaaugaacagcaaagcauu

SEQ ID NO: 2147 - RNA, 21 nt, Artificial Sequence
  source: /note="Description of Artificial Sequence: Synthetic oligonucleotide"
ccaaugaacagcaaagcauau

SEQ ID NO: 2148 - RNA, 21 nt, Artificial Sequence
  source: /note="Description of Artificial Sequence: Synthetic oligonucleotide"
caaugaacagcaaagcauaau

SEQ ID NO: 2149 - RNA, 21 nt, Artificial Sequence
  source: /note="Description of Artificial Sequence: Synthetic oligonucleotide"
aaugaacagcaaagcauaacu

SEQ ID NO: 2150 - RNA, 21 nt, Artificial Sequence
  source: /note="Description of Artificial Sequence: Synthetic oligonucleotide"
augaacagcaaagcauaaccu

SEQ ID NO: 2151 - RNA, 21 nt, Artificial Sequence
  source: /note="Description of Artificial Sequence: Synthetic oligonucleotide"
ugaacagcaaagcauaaccuu

SEQ ID NO: 2152 - RNA, 21 nt, Artificial Sequence
  source: /note="Description of Artificial Sequence: Synthetic oligonucleotide"
acagcaaagcauaaccuugau

SEQ ID NO: 2153 - RNA, 21 nt, Artificial Sequence
  source: /note="Description of Artificial Sequence: Synthetic oligonucleotide"
cagcaaagcauaaccuugaau

SEQ ID NO: 2154 - RNA, 21 nt, Artificial Sequence
  source: /note="Description of Artificial Sequence: Synthetic oligonucleotide"
aaagcauaaccuugaaucuau

SEQ ID NO: 2155 - RNA, 21 nt, Artificial Sequence
  source: /note="Description of Artificial Sequence: Synthetic oligonucleotide"
aagcauaaccuugaaucuauu

SEQ ID NO: 2156 - RNA, 21 nt, Artificial Sequence
  source: /note="Description of Artificial Sequence: Synthetic oligonucleotide"
agcauaaccuugaaucuauau

SEQ ID NO: 2157 - RNA, 21 nt, Artificial Sequence
  source: /note="Description of Artificial Sequence: Synthetic oligonucleotide"
cuugaaucuauacucaaauuu

SEQ ID NO: 2158 - RNA, 21 nt, Artificial Sequence
  source: /note="Description of Artificial Sequence: Synthetic oligonucleotide"
uugaaucuauacucaaauuuu

SEQ ID NO: 2159 - RNA, 21 nt, Artificial Sequence
  source: /note="Description of Artificial Sequence: Synthetic oligonucleotide"
gaaucuauacucaaauuuugu

SEQ ID NO: 2160 - RNA, 21 nt, Artificial Sequence
  source: /note="Description of Artificial Sequence: Synthetic oligonucleotide"
ucuauacucaaauuuugcaau

SEQ ID NO: 2161 - RNA, 21 nt, Artificial Sequence
  source: /note="Description of Artificial Sequence: Synthetic oligonucleotide"
cuauacucaaauuuugcaauu

SEQ ID NO: 2162 - RNA, 21 nt, Artificial Sequence
  source: /note="Description of Artificial Sequence: Synthetic oligonucleotide"
uauacucaaauuuugcaaugu

SEQ ID NO: 2163 - RNA, 21 nt, Artificial Sequence
  source: /note="Description of Artificial Sequence: Synthetic oligonucleotide"
auacucaaauuuugcaaugau

SEQ ID NO: 2164 - RNA, 21 nt, Artificial Sequence
  source: /note="Description of Artificial Sequence: Synthetic oligonucleotide"
uacucaaauuuugcaaugagu

SEQ ID NO: 2165 - RNA, 21 nt, Artificial Sequence
  source: /note="Description of Artificial Sequence: Synthetic oligonucleotide"
acucaaauuuugcaaugaggu

SEQ ID NO: 2166 - RNA, 21 nt, Artificial Sequence
  source: /note="Description of Artificial Sequence: Synthetic oligonucleotide"
cucaaauuuugcaaugaggcu

SEQ ID NO: 2167 - RNA, 21 nt, Artificial Sequence
  source: /note="Description of Artificial Sequence: Synthetic oligonucleotide"
ucaaauuuugcaaugaggcau

SEQ ID NO: 2168 - RNA, 21 nt, Artificial Sequence
  source: /note="Description of Artificial Sequence: Synthetic oligonucleotide"
caaauuuugcaaugaggcagu

SEQ ID NO: 2169 - RNA, 21 nt, Artificial Sequence
  source: /note="Description of Artificial Sequence: Synthetic oligonucleotide"
aaauuuugcaaugaggcaguu

SEQ ID NO: 2170 - RNA, 21 nt, Artificial Sequence
  source: /note="Description of Artificial Sequence: Synthetic oligonucleotide"
aauuuugcaaugaggcagugu

SEQ ID NO: 2171 - RNA, 21 nt, Artificial Sequence
  source: /note="Description of Artificial Sequence: Synthetic oligonucleotide"
auuuugcaaugaggcaguggu

SEQ ID NO: 2172 - RNA, 21 nt, Artificial Sequence
  source: /note="Description of Artificial Sequence: Synthetic oligonucleotide"
cucuccaaguaugaucgucuu

SEQ ID NO: 2173 - RNA, 21 nt, Artificial Sequence
  source: /note="Description of Artificial Sequence: Synthetic oligonucleotide"
aggaucucucucagaguauuu

SEQ ID NO: 2174 - RNA, 21 nt, Artificial Sequence
  source: /note="Description of Artificial Sequence: Synthetic oligonucleotide"
cagugaugcucuccaaguauu

SEQ ID NO: 2175 - RNA, 21 nt, Artificial Sequence
  source: /note="Description of Artificial Sequence: Synthetic oligonucleotide"
ccaaguaugaucgucugcagu

SEQ ID NO: 2176 - RNA, 21 nt, Artificial Sequence
  source: /note="Description of Artificial Sequence: Synthetic oligonucleotide"
guuuguuucauuuccgcugau

SEQ ID NO: 2177 - RNA, 21 nt, Artificial Sequence
  source: /note="Description of Artificial Sequence: Synthetic oligonucleotide"
aacacccaggaucucucucau

SEQ ID NO: 2178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguuuguuuguuucauuucu

SEQ ID NO: 2179 - RNA, 21 nt, Artificial Sequence
  source: /note="Description of Artificial Sequence: Synthetic oligonucleotide"
gaguauuucucagcauucaau

SEQ ID NO: 2180 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auactuggagagcaucacugugc

SEQ ID NO: 2181 - RNA, 23 nt, Artificial Sequence
  source: /note="Description of Artificial Sequence: Synthetic oligonucleotide"
aauacuuggagagcaucacugug

SEQ ID NO: 2182 - RNA, 23 nt, Artificial Sequence
  source: /note="Description of Artificial Sequence: Synthetic oligonucleotide"
acauacuuggagagcaucacugu

SEQ ID NO: 2183 - RNA, 23 nt, Artificial Sequence
  source: /note="Description of Artificial Sequence: Synthetic oligonucleotide"
aucauacuuggagagcaucacug

SEQ ID NO: 2184 - RNA, 23 nt, Artificial Sequence
  source: /note="Description of Artificial Sequence: Synthetic oligonucleotide"
aaucauacuuggagagcaucacu

SEQ ID NO: 2185 - RNA, 23 nt, Artificial Sequence
  source: /note="Description of Artificial Sequence: Synthetic oligonucleotide"
acagacgaucauacuuggagagc

SEQ ID NO: 2186 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcagacgaucauacuuggagag

SEQ ID NO: 2187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augcagacgaucauacuuggaga

SEQ ID NO: 2188 - RNA, 23 nt, Artificial Sequence
  source: /note="Description of Artificial Sequence: Synthetic oligonucleotide"
acugcagacgaucauacuuggag

SEQ ID NO: 2189 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucugcagacgaucauacuugga

SEQ ID NO: 2190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuctgcagacgaucauacuugg

SEQ ID NO: 2191 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguucugcagacgaucauacuug

SEQ ID NO: 2192 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augutctgcagacgaucauacuu

SEQ ID NO: 2193 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auugtucugcagacgaucauacu

SEQ ID NO: 2194 - RNA, 23 nt, Artificial Sequence
  source: /note="Description of Artificial Sequence: Synthetic oligonucleotide"
acuuguucugcagacgaucauac

SEQ ID NO: 2195 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctugaaugcugagaaauacu

SEQ ID NO: 2196 - RNA, 23 nt, Artificial Sequence
  source: /note="Description of Artificial Sequence: Synthetic oligonucleotide"
acugcuugaaugcugagaaauac

SEQ ID NO: 2197 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accugctugaaugcugagaaaua

SEQ ID NO: 2198 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctgcuugaaugcugagaaau

SEQ ID NO: 2199 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggccugcuugaaugcugagaaa

SEQ ID NO: 2200 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaggcctgcuugaaugcugagaa

SEQ ID NO: 2201 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaggccugcuugaaugcugaga

SEQ ID NO: 2202 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggaggccugcuugaaugcugag

SEQ ID NO: 2203 - RNA, 23 nt, Artificial Sequence
  source: /note="Description of Artificial Sequence: Synthetic oligonucleotide"
aacaaacccuggaaccuucuuag

SEQ ID NO: 2204 - RNA, 23 nt, Artificial Sequence
  source: /note="Description of Artificial Sequence: Synthetic oligonucleotide"
aaacaaacccuggaaccuucuua

SEQ ID NO: 2205 - RNA, 23 nt, Artificial Sequence
  source: /note="Description of Artificial Sequence: Synthetic oligonucleotide"
aaaacaaacccuggaaccuucuu

SEQ ID NO: 2206 - RNA, 23 nt, Artificial Sequence
  source: /note="Description of Artificial Sequence: Synthetic oligonucleotide"
acaaacaaacccuggaaccuucu

SEQ ID NO: 2207 - RNA, 23 nt, Artificial Sequence
  source: /note="Description of Artificial Sequence: Synthetic oligonucleotide"
aacaaacaaacccuggaaccuuc

SEQ ID NO: 2208 - RNA, 23 nt, Artificial Sequence
  source: /note="Description of Artificial Sequence: Synthetic oligonucleotide"
aaacaaacaaacccuggaaccuu

SEQ ID NO: 2209 - RNA, 23 nt, Artificial Sequence
  source: /note="Description of Artificial Sequence: Synthetic oligonucleotide"
aaaacaaacaaacccuggaaccu

SEQ ID NO: 2210 - RNA, 23 nt, Artificial Sequence
  source: /note="Description of Artificial Sequence: Synthetic oligonucleotide"
augaaacaaacaaacccuggaac

SEQ ID NO: 2211 - RNA, 23 nt, Artificial Sequence
  source: /note="Description of Artificial Sequence: Synthetic oligonucleotide"
aaugaaacaaacaaacccuggaa

SEQ ID NO: 2212 - RNA, 23 nt, Artificial Sequence
  source: /note="Description of Artificial Sequence: Synthetic oligonucleotide"
acggaaaugaaacaaacaaaccc

SEQ ID NO: 2213 - RNA, 23 nt, Artificial Sequence
  source: /note="Description of Artificial Sequence: Synthetic oligonucleotide"
agcggaaaugaaacaaacaaacc

SEQ ID NO: 2214 - RNA, 23 nt, Artificial Sequence
  source: /note="Description of Artificial Sequence: Synthetic oligonucleotide"
acagcggaaaugaaacaaacaaa

SEQ ID NO: 2215 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucagcggaaaugaaacaaacaa

SEQ ID NO: 2216 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucagcggaaaugaaacaaaca

SEQ ID NO: 2217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaucagcggaaaugaaacaaac

SEQ ID NO: 2218 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatcagcggaaaugaaacaaa

SEQ ID NO: 2219 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucaucagcggaaaugaaacaa

SEQ ID NO: 2220 - RNA, 23 nt, Artificial Sequence
  source: /note="Description of Artificial Sequence: Synthetic oligonucleotide"
acaucaucagcggaaaugaaaca

SEQ ID NO: 2221 - RNA, 23 nt, Artificial Sequence
  source: /note="Description of Artificial Sequence: Synthetic oligonucleotide"
aacacaaagagcuccaucucccc

SEQ ID NO: 2222 - RNA, 23 nt, Artificial Sequence
  source: /note="Description of Artificial Sequence: Synthetic oligonucleotide"
agacacaaagagcuccaucuccc

SEQ ID NO: 2223 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacacaaagagcuccaucucc

SEQ ID NO: 2224 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagacacaaagagcuccaucuc

SEQ ID NO: 2225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguagacacaaagagcuccaucu

SEQ ID NO: 2226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagacacaaagagcuccauc

SEQ ID NO: 2227 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agugtagacacaaagagcuccau

SEQ ID NO: 2228 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguguagacacaaagagcucca

SEQ ID NO: 2229 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggugutcuguguagacacaaag

SEQ ID NO: 2230 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggtgtucuguguagacacaaa

SEQ ID NO: 2231 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugguguucuguguagacacaa

SEQ ID NO: 2232 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauggtguucuguguagacaca

SEQ ID NO: 2233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatgguguucuguguagacac

SEQ ID NO: 2234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auucaugguguucuguguagaca

SEQ ID NO: 2235 - RNA, 23 nt, Artificial Sequence
  source: /note="Description of Artificial Sequence: Synthetic oligonucleotide"
acuucaugguguucuguguagac

SEQ ID NO: 2236 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucutcaugguguucuguguaga

SEQ ID NO: 2237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagagauccuggguguucccca

SEQ ID NO: 2238 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagagagauccuggguguucccc

SEQ ID NO: 2239 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agagagagauccuggguguuccc

SEQ ID NO: 2240 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augagagagauccuggguguucc

SEQ ID NO: 2241 - RNA, 23 nt, Artificial Sequence
  source: /note="Description of Artificial Sequence: Synthetic oligonucleotide"
acugagagagauccuggguguuc

SEQ ID NO: 2242 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucugagagagauccuggguguu

SEQ ID NO: 2243 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuctgagagagauccugggugu

SEQ ID NO: 2244 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacucugagagagauccugggug

SEQ ID NO: 2245 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auactctgagagagauccugggu

SEQ ID NO: 2246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauacucugagagagauccuggg

SEQ ID NO: 2247 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgtuccauaauacucugagag

SEQ ID NO: 2248 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagctcguuccauaauacucuga

SEQ ID NO: 2249 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcucguuccauaauacucug

SEQ ID NO: 2250 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagctcguuccauaauacucu

SEQ ID NO: 2251 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaagcucguuccauaauacuc

SEQ ID NO: 2252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauaaagcucguuccauaauacu

SEQ ID NO: 2253 - RNA, 23 nt, Artificial Sequence
  source: /note="Description of Artificial Sequence: Synthetic oligonucleotide"
aaauaaagcucguuccauaauac

SEQ ID NO: 2254 - RNA, 23 nt, Artificial Sequence
  source: /note="Description of Artificial Sequence: Synthetic oligonucleotide"
agaauaaagcucguuccauaaua

SEQ ID NO: 2255 - RNA, 23 nt, Artificial Sequence
  source: /note="Description of Artificial Sequence: Synthetic oligonucleotide"
aggaauaaagcucguuccauaau

SEQ ID NO: 2256 - RNA, 23 nt, Artificial Sequence
  source: /note="Description of Artificial Sequence: Synthetic oligonucleotide"
aauagaagcagccaggaagaggg

SEQ ID NO: 2257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauagaagcagccaggaagagg

SEQ ID NO: 2258 - RNA, 23 nt, Artificial Sequence
  source: /note="Description of Artificial Sequence: Synthetic oligonucleotide"
aagauagaagcagccaggaagag

SEQ ID NO: 2259 - RNA, 23 nt, Artificial Sequence
  source: /note="Description of Artificial Sequence: Synthetic oligonucleotide"
acaaagaagauagaagcagccag

SEQ ID NO: 2260 - RNA, 23 nt, Artificial Sequence
  source: /note="Description of Artificial Sequence: Synthetic oligonucleotide"
aaucuuugauggcaaagaagaua

SEQ ID NO: 2261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcatctuugauggcaaagaaga

SEQ ID NO: 2262 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggcaucuuugauggcaaagaag

SEQ ID NO: 2263 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auggcatcuuugauggcaaagaa

SEQ ID NO: 2264 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauggcaucuuugauggcaaaga

SEQ ID NO: 2265 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agauggcaucuuugauggcaaag

SEQ ID NO: 2266 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggatggcaucuuugauggcaaa

SEQ ID NO: 2267 - RNA, 23 nt, Artificial Sequence
  source: /note="Description of Artificial Sequence: Synthetic oligonucleotide"
acggauggcaucuuugauggcaa

SEQ ID NO: 2268 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcutugcuguucauugguuuga

SEQ ID NO: 2269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augctutgcuguucauugguuug

SEQ ID NO: 2270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaugcutugcuguucauugguuu

SEQ ID NO: 2271 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaugctuugcuguucauugguu

SEQ ID NO: 2272 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuatgcuuugcuguucauuggu

SEQ ID NO: 2273 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuaugcuuugcuguucauugg

SEQ ID NO: 2274 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aggutatgcuuugcuguucauug

SEQ ID NO: 2275 - RNA, 23 nt, Artificial Sequence
  source: /note="Description of Artificial Sequence: Synthetic oligonucleotide"
aagguuaugcuuugcuguucauu

SEQ ID NO: 2276 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucaagguuaugcuuugcuguuc

SEQ ID NO: 2277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auucaagguuaugcuuugcuguu

SEQ ID NO: 2278 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagautcaagguuaugcuuugc

SEQ ID NO: 2279 - RNA, 23 nt, Artificial Sequence
  source: /note="Description of Artificial Sequence: Synthetic oligonucleotide"
aauagauucaagguuaugcuuug

SEQ ID NO: 2280 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auauagauucaagguuaugcuuu

SEQ ID NO: 2281 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaautugaguauagauucaaggu

SEQ ID NO: 2282 - RNA, 23 nt, Artificial Sequence
  source: /note="Description of Artificial Sequence: Synthetic oligonucleotide"
aaaauuugaguauagauucaagg

SEQ ID NO: 2283 - RNA, 23 nt, Artificial Sequence
  source: /note="Description of Artificial Sequence: Synthetic oligonucleotide"
acaaaauuugaguauagauucaa

SEQ ID NO: 2284 - RNA, 23 nt, Artificial Sequence
  source: /note="Description of Artificial Sequence: Synthetic oligonucleotide"
auugcaaaauuugaguauagauu

SEQ ID NO: 2285 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugcaaaauuugaguauagau

SEQ ID NO: 2286 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acautgcaaaauuugaguauaga

SEQ ID NO: 2287 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucatugcaaaauuugaguauag

SEQ ID NO: 2288 - RNA, 23 nt, Artificial Sequence
  source: /note="Description of Artificial Sequence: Synthetic oligonucleotide"
acucauugcaaaauuugaguaua

SEQ ID NO: 2289 - RNA, 23 nt, Artificial Sequence
  source: /note="Description of Artificial Sequence: Synthetic oligonucleotide"
accucauugcaaaauuugaguau

SEQ ID NO: 2290 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcctcauugcaaaauuugagua

SEQ ID NO: 2291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augccucauugcaaaauuugagu

SEQ ID NO: 2292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugcctcauugcaaaauuugag

SEQ ID NO: 2293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacugccucauugcaaaauuuga

SEQ ID NO: 2294 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acactgccucauugcaaaauuug

SEQ ID NO: 2295 - RNA, 23 nt, Artificial Sequence
  source: /note="Description of Artificial Sequence: Synthetic oligonucleotide"
accacugccucauugcaaaauuu

SEQ ID NO: 2296 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagacgaucauacuuggagagcg

SEQ ID NO: 2297 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauactcugagagagauccugg

SEQ ID NO: 2298 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauacutggagagcaucacugug

SEQ ID NO: 2299 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugcagacgatcauacuuggag

SEQ ID NO: 2300 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atcagcggaaatgaaacaaacgg

SEQ ID NO: 2301 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atgagagagauccuggguguucc

SEQ ID NO: 2302 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaaugaaacaaacaaacccug

SEQ ID NO: 2303 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
atugaatgcugagaaauacuccc

SEQ ID NO: 2304 - RNA, 23 nt, Homo sapiens
gcacagugaugcucuccaaguau

SEQ ID NO: 2305 - RNA, 23 nt, Homo sapiens
cacagugaugcucuccaaguaug

SEQ ID NO: 2306 - RNA, 23 nt, Homo sapiens
acagugaugcucuccaaguauga

SEQ ID NO: 2307 - RNA, 23 nt, Homo sapiens
cagugaugcucuccaaguaugau

SEQ ID NO: 2308 - RNA, 23 nt, Homo sapiens
agugaugcucuccaaguaugauc

SEQ ID NO: 2309 - RNA, 23 nt, Homo sapiens
gcucuccaaguaugaucgucugc

SEQ ID NO: 2310 - RNA, 23 nt, Homo sapiens
cucuccaaguaugaucgucugca

SEQ ID NO: 2311 - RNA, 23 nt, Homo sapiens
ucuccaaguaugaucgucugcag

SEQ ID NO: 2312 - RNA, 23 nt, Homo sapiens
cuccaaguaugaucgucugcaga

SEQ ID NO: 2313 - RNA, 23 nt, Homo sapiens
uccaaguaugaucgucugcagaa

SEQ ID NO: 2314 - RNA, 23 nt, Homo sapiens
ccaaguaugaucgucugcagaac

SEQ ID NO: 2315 - RNA, 23 nt, Homo sapiens
caaguaugaucgucugcagaaca

SEQ ID NO: 2316 - RNA, 23 nt, Homo sapiens
aaguaugaucgucugcagaacaa

SEQ ID NO: 2317 - RNA, 23 nt, Homo sapiens
aguaugaucgucugcagaacaag

SEQ ID NO: 2318 - RNA, 23 nt, Homo sapiens
guaugaucgucugcagaacaaga

SEQ ID NO: 2319 - RNA, 23 nt, Homo sapiens
aguauuucucagcauucaagcag

SEQ ID NO: 2320 - RNA, 23 nt, Homo sapiens
guauuucucagcauucaagcagg

SEQ ID NO: 2321 - RNA, 23 nt, Homo sapiens
uauuucucagcauucaagcaggc

SEQ ID NO: 2322 - RNA, 23 nt, Homo sapiens
auuucucagcauucaagcaggcc

SEQ ID NO: 2323 - RNA, 23 nt, Homo sapiens
uuucucagcauucaagcaggccu

SEQ ID NO: 2324 - RNA, 23 nt, Homo sapiens
uucucagcauucaagcaggccuc

SEQ ID NO: 2325 - RNA, 23 nt, Homo sapiens
ucucagcauucaagcaggccucc

SEQ ID NO: 2326 - RNA, 23 nt, Homo sapiens
cucagcauucaagcaggccuccc

SEQ ID NO: 2327 - RNA, 23 nt, Homo sapiens
cuaagaagguuccaggguuuguu

SEQ ID NO: 2328 - RNA, 23 nt, Homo sapiens
uaagaagguuccaggguuuguuu

SEQ ID NO: 2329 - RNA, 23 nt, Homo sapiens
aagaagguuccaggguuuguuug

SEQ ID NO: 2330 - RNA, 23 nt, Homo sapiens
agaagguuccaggguuuguuugu

SEQ ID NO: 2331 - RNA, 23 nt, Homo sapiens
gaagguuccaggguuuguuuguu

SEQ ID NO: 2332 - RNA, 23 nt, Homo sapiens
aagguuccaggguuuguuuguuu

SEQ ID NO: 2333 - RNA, 23 nt, Homo sapiens
agguuccaggguuuguuuguuuc

SEQ ID NO: 2334 - RNA, 23 nt, Homo sapiens
guuccaggguuuguuuguuucau

SEQ ID NO: 2335 - RNA, 23 nt, Homo sapiens
uuccaggguuuguuuguuucauu

SEQ ID NO: 2336 - RNA, 23 nt, Homo sapiens
ggguuuguuuguuucauuuccgc

SEQ ID NO: 2337 - RNA, 23 nt, Homo sapiens
gguuuguuuguuucauuuccgcu

SEQ ID NO: 2338 - RNA, 23 nt, Homo sapiens
uuuguuuguuucauuuccgcuga

SEQ ID NO: 2339 - RNA, 23 nt, Homo sapiens
uuguuuguuucauuuccgcugau

SEQ ID NO: 2340 - RNA, 23 nt, Homo sapiens
uguuuguuucauuuccgcugaug

SEQ ID NO: 2341 - RNA, 23 nt, Homo sapiens
guuuguuucauuuccgcugauga

SEQ ID NO: 2342 - RNA, 23 nt, Homo sapiens
uuuguuucauuuccgcugaugau

SEQ ID NO: 2343 - RNA, 23 nt, Homo sapiens
uuguuucauuuccgcugaugaug

SEQ ID NO: 2344 - RNA, 23 nt, Homo sapiens
uguuucauuuccgcugaugaugu

SEQ ID NO: 2345 - RNA, 23 nt, Homo sapiens
ggggagauggagcucuuuguguc

SEQ ID NO: 2346 - RNA, 23 nt, Homo sapiens
gggagauggagcucuuugugucu

SEQ ID NO: 2347 - RNA, 23 nt, Homo sapiens
ggagauggagcucuuugugucua

SEQ ID NO: 2348 - RNA, 23 nt, Homo sapiens
gagauggagcucuuugugucuac

SEQ ID NO: 2349 - RNA, 23 nt, Homo sapiens
agauggagcucuuugugucuaca

SEQ ID NO: 2350 - RNA, 23 nt, Homo sapiens
gauggagcucuuugugucuacac

SEQ ID NO: 2351 - RNA, 23 nt, Homo sapiens
auggagcucuuugugucuacaca

SEQ ID NO: 2352 - RNA, 23 nt, Homo sapiens
uggagcucuuugugucuacacag

SEQ ID NO: 2353 - RNA, 23 nt, Homo sapiens
cuuugugucuacacagaacacca

SEQ ID NO: 2354 - RNA, 23 nt, Homo sapiens
uuugugucuacacagaacaccau

SEQ ID NO: 2355 - RNA, 23 nt, Homo sapiens
uugugucuacacagaacaccaug

SEQ ID NO: 2356 - RNA, 23 nt, Homo sapiens
ugugucuacacagaacaccauga

SEQ ID NO: 2357 - RNA, 23 nt, Homo sapiens
gugucuacacagaacaccaugaa

SEQ ID NO: 2358 - RNA, 23 nt, Homo sapiens
ugucuacacagaacaccaugaag

SEQ ID NO: 2359 - RNA, 23 nt, Homo sapiens
gucuacacagaacaccaugaaga

SEQ ID NO: 2360 - RNA, 23 nt, Homo sapiens
ucuacacagaacaccaugaagac

SEQ ID NO: 2361 - RNA, 23 nt, Homo sapiens
uggggaacacccaggaucucucu

SEQ ID NO: 2362 - RNA, 23 nt, Homo sapiens
ggggaacacccaggaucucucuc

SEQ ID NO: 2363 - RNA, 23 nt, Homo sapiens
gggaacacccaggaucucucuca

SEQ ID NO: 2364 - RNA, 23 nt, Homo sapiens
ggaacacccaggaucucucucag

SEQ ID NO: 2365 - RNA, 23 nt, Homo sapiens
gaacacccaggaucucucucaga

SEQ ID NO: 2366 - RNA, 23 nt, Homo sapiens
aacacccaggaucucucucagag

SEQ ID NO: 2367 - RNA, 23 nt, Homo sapiens
acacccaggaucucucucagagu

SEQ ID NO: 2368 - RNA, 23 nt, Homo sapiens
cacccaggaucucucucagagua

SEQ ID NO: 2369 - RNA, 23 nt, Homo sapiens
acccaggaucucucucagaguau

SEQ ID NO: 2370 - RNA, 23 nt, Homo sapiens
cccaggaucucucucagaguauu

SEQ ID NO: 2371 - RNA, 23 nt, Homo sapiens
cucucagaguauuauggaacgag

SEQ ID NO: 2372 - RNA, 23 nt, Homo sapiens
ucagaguauuauggaacgagcuu

SEQ ID NO: 2373 - RNA, 23 nt, Homo sapiens
cagaguauuauggaacgagcuuu

SEQ ID NO: 2374 - RNA, 23 nt, Homo sapiens
agaguauuauggaacgagcuuua

SEQ ID NO: 2375 - RNA, 23 nt, Homo sapiens
gaguauuauggaacgagcuuuau

SEQ ID NO: 2376 - RNA, 23 nt, Homo sapiens
aguauuauggaacgagcuuuauu

SEQ ID NO: 2377 - RNA, 23 nt, Homo sapiens
guauuauggaacgagcuuuauuc

SEQ ID NO: 2378 - RNA, 23 nt, Homo sapiens
uauuauggaacgagcuuuauucc

SEQ ID NO: 2379 - RNA, 23 nt, Homo sapiens
auuauggaacgagcuuuauucca

SEQ ID NO: 2380 - RNA, 23 nt, Homo sapiens
cccucuuccuggcugcuucuauc

SEQ ID NO: 2381 - RNA, 23 nt, Homo sapiens
ccucuuccuggcugcuucuaucu

SEQ ID NO: 2382 - RNA, 23 nt, Homo sapiens
cucuuccuggcugcuucuaucuu

SEQ ID NO: 2383 - RNA, 23 nt, Homo sapiens
cuggcugcuucuaucuucuuugc

SEQ ID NO: 2384 - RNA, 23 nt, Homo sapiens
uaucuucuuugccaucaaagaug

SEQ ID NO: 2385 - RNA, 23 nt, Homo sapiens
ucuucuuugccaucaaagaugcc

SEQ ID NO: 2386 - RNA, 23 nt, Homo sapiens
cuucuuugccaucaaagaugcca

SEQ ID NO: 2387 - RNA, 23 nt, Homo sapiens
uucuuugccaucaaagaugccau

SEQ ID NO: 2388 - RNA, 23 nt, Homo sapiens
ucuuugccaucaaagaugccauc

SEQ ID NO: 2389 - RNA, 23 nt, Homo sapiens
cuuugccaucaaagaugccaucc

SEQ ID NO: 2390 - RNA, 23 nt, Homo sapiens
uuugccaucaaagaugccauccg

SEQ ID NO: 2391 - RNA, 23 nt, Homo sapiens
uugccaucaaagaugccauccgu

SEQ ID NO: 2392 - RNA, 23 nt, Homo sapiens
ucaaaccaaugaacagcaaagca

SEQ ID NO: 2393 - RNA, 23 nt, Homo sapiens
caaaccaaugaacagcaaagcau

SEQ ID NO: 2394 - RNA, 23 nt, Homo sapiens
aaaccaaugaacagcaaagcaua

SEQ ID NO: 2395 - RNA, 23 nt, Homo sapiens
aaccaaugaacagcaaagcauaa

SEQ ID NO: 2396 - RNA, 23 nt, Homo sapiens
accaaugaacagcaaagcauaac

SEQ ID NO: 2397 - RNA, 23 nt, Homo sapiens
ccaaugaacagcaaagcauaacc

SEQ ID NO: 2398 - RNA, 23 nt, Homo sapiens
caaugaacagcaaagcauaaccu

SEQ ID NO: 2399 - RNA, 23 nt, Homo sapiens
aaugaacagcaaagcauaaccuu

SEQ ID NO: 2400 - RNA, 23 nt, Homo sapiens
gaacagcaaagcauaaccuugaa

SEQ ID NO: 2401 - RNA, 23 nt, Homo sapiens
aacagcaaagcauaaccuugaau

SEQ ID NO: 2402 - RNA, 23 nt, Homo sapiens
gcaaagcauaaccuugaaucuau

SEQ ID NO: 2403 - RNA, 23 nt, Homo sapiens
caaagcauaaccuugaaucuaua

SEQ ID NO: 2404 - RNA, 23 nt, Homo sapiens
aaagcauaaccuugaaucuauac

SEQ ID NO: 2405 - RNA, 23 nt, Homo sapiens
accuugaaucuauacucaaauuu

SEQ ID NO: 2406 - RNA, 23 nt, Homo sapiens
ccuugaaucuauacucaaauuuu

SEQ ID NO: 2407 - RNA, 23 nt, Homo sapiens
uugaaucuauacucaaauuuugc

SEQ ID NO: 2408 - RNA, 23 nt, Homo sapiens
aaucuauacucaaauuuugcaau

SEQ ID NO: 2409 - RNA, 23 nt, Homo sapiens
aucuauacucaaauuuugcaaug

SEQ ID NO: 2410 - RNA, 23 nt, Homo sapiens
ucuauacucaaauuuugcaauga

SEQ ID NO: 2411 - RNA, 23 nt, Homo sapiens
cuauacucaaauuuugcaaugag

SEQ ID NO: 2412 - RNA, 23 nt, Homo sapiens
uauacucaaauuuugcaaugagg

SEQ ID NO: 2413 - RNA, 23 nt, Homo sapiens
auacucaaauuuugcaaugaggc

SEQ ID NO: 2414 - RNA, 23 nt, Homo sapiens
uacucaaauuuugcaaugaggca

SEQ ID NO: 2415 - RNA, 23 nt, Homo sapiens
acucaaauuuugcaaugaggcag

SEQ ID NO: 2416 - RNA, 23 nt, Homo sapiens
cucaaauuuugcaaugaggcagu

SEQ ID NO: 2417 - RNA, 23 nt, Homo sapiens
ucaaauuuugcaaugaggcagug

SEQ ID NO: 2418 - RNA, 23 nt, Homo sapiens
caaauuuugcaaugaggcagugg

SEQ ID NO: 2419 - RNA, 23 nt, Homo sapiens
aaauuuugcaaugaggcaguggg

We claim:

1. A double stranded ribonucleic acid (dsRNA) agent for inhibiting expression of xanthine dehydrogenase (XDH) in a cell,
   wherein the dsRNA agent comprises a sense strand and an antisense strand forming a double stranded region,
   wherein the sense strand comprises at least 19 contiguous nucleotides differing by no more than 3 nucleotides from the nucleotide sequence of nucleotides 2691-2722 of SEQ ID NO: 1, and the antisense strand comprises a nucleotide sequence selected from the group consisting of
   5'-AAAUACTCUGAGAGAGAUCCUGG-3'(SEQ ID NO:485);
   5'-AUAAUACUCUGAGAGAGAUCCUG-3'(SEQ ID NO:486);
   5'-AAUAAUACUCUGAGAGAGAUCCU-3'(SEQ ID NO:487);
   5'-ACAUAAUACUCUGAGAGAGAUCC-3'(SEQ ID NO:488);
   5'-ACCAUAAUACUCUGAGAGAGAUC-3'(SEQ ID NO:489);
   5'-AUCCAUAAUACUCUGAGAGAGAU-3'(SEQ ID NO:490);
   5'-AUUCCAUAAUACUCUGAGAGAGA-3'(SEQ ID NO:491);
   5'-AGUUCCAUAAUACUCUGAGAGAG-3'(SEQ ID NO:492);
   5'-ACGUUCCAUAAUACUCUGAGAGA-3'(SEQ ID NO:493);
   5'-ACUCGUUCCAUAAUACUCUGAGA-3'(SEQ ID NO:494); and
   5'-AGCUCGUUCCAUAAUACUCUGAG-3'(SEQ ID NO:495),
   wherein all of the nucleotides of the sense strand and all of the nucleotides of the antisense strand are modified nucleotides,
   wherein the sense strand comprises two phosphorothioate internucleotide linkages at the 5'-terminus, and
   wherein the antisense strand comprises two phosphorothioate internucleotide linkages at the 5'-terminus and two phosphorothioate internucleotide linkages at the 3'-terminus.

2. The dsRNA agent of claim 1, wherein at least one of the modified nucleotides is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a nucleotide comprising a 2'-phosphate, a thermally destabilizing nucleotide, a glycol modified nucleotide (GNA), and a 2-O—(N-methylacetamide) modified nucleotide; and combinations thereof.

3. The dsRNA agent of claim 1, wherein the sense strand and the antisense strand are each independently 19-25 nucleotides in length.

4. The dsRNA agent of claim 1, wherein at least one strand comprises a 3' overhang of at least 1 nucleotide.

5. The dsRNA agent of claim 1, further comprising a ligand.

6. The dsRNA agent of claim 5, wherein the ligand is conjugated to the 3' end of the sense strand of the dsRNA agent.

7. The dsRNA agent of claim 6, wherein the ligand is an N-acetylgalactosamine (GalNAc) derivative.

8. The dsRNA agent of claim 7, wherein the ligand is

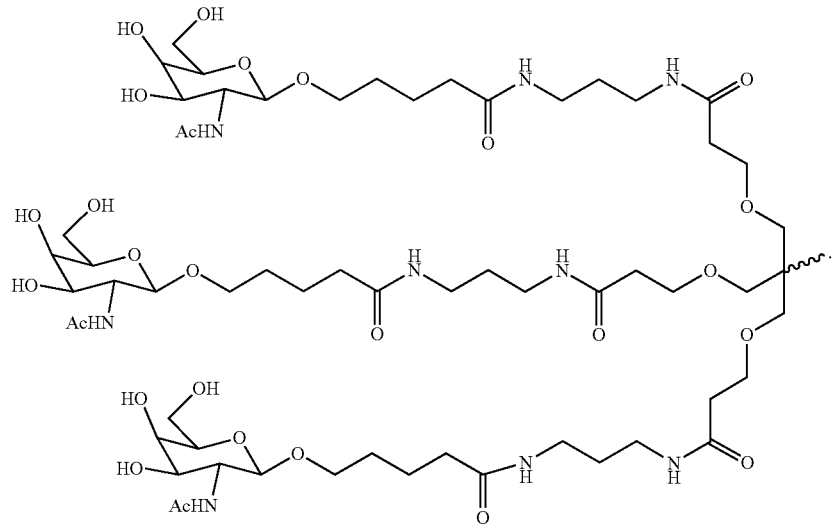 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

9. The dsRNA agent of claim 8, wherein the dsRNA agent is conjugated to the ligand as shown in the following schematic

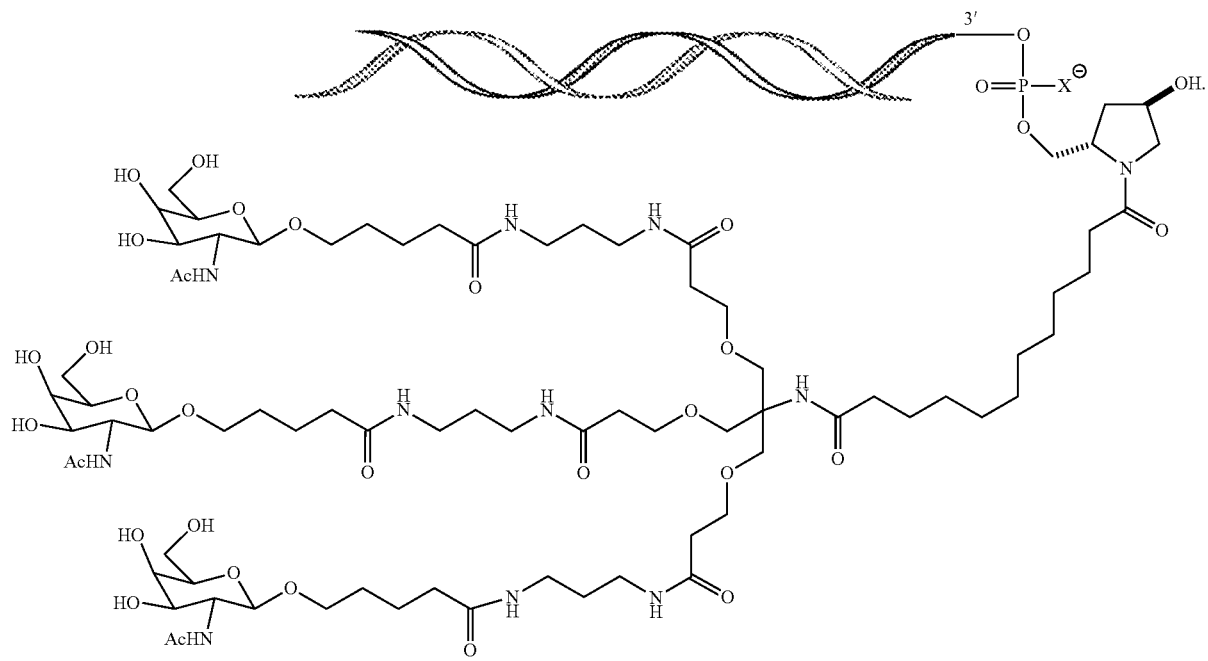

and, wherein X is O or S.

10. The dsRNA agent of claim 1, wherein the sense strand and the antisense strand comprise nucleotide sequences selected from the group consisting of 5'-AGGAUCUCUCUCAGAGUAUUU-3'(SEQ ID NO:126) and 5'-AAAUACTCUGAGAGAGAUC-CUGG-3'(SEQ ID NO:485);

5'-GGAUCUCUCUCAGAGUAUUAU-3'(SEQ ID NO:127) and 5'-AUAAUACUCUGAGAGAGAUC-CUG-3'(SEQ ID NO:486);

5'-GAUCUCUCUCAGAGUAUUAUU-3'(SEQ ID NO:128) and 5'-AAUAAUACU-CUGAGAGAGAUCCU-3'(SEQ ID NO:487);

5'-AUCUCUCUCAGAGUAUUAUGU-3'(SEQ ID NO:129) and 5'-ACAUAAUACU-CUGAGAGAGAUCC-3'(SEQ ID NO:488);

5'-UCUCUCUCAGAGUAUUAUGGU-3'(SEQ ID NO:130) and 5'-ACCAUAAUACU-CUGAGAGAGAUC-3'(SEQ ID NO:489);

5'-CUCUCUCAGAGUAUUAUGGAU-3'(SEQ ID NO:131) and 5'-AUCCAUAAUACU-CUGAGAGAGAU-3'(SEQ ID NO:490);

5'-UCUCUCAGAGUAUUAUGGAAU-3'(SEQ ID NO:132) and 5'-AUUCCAUAAUACU-CUGAGAGAGA-3'(SEQ ID NO:491);

5'-CUCUCAGAGUAUUAUGGAACU-3'(SEQ ID NO:133) and 5'-AGUUCCAUAAUACU-CUGAGAGAG-3'(SEQ ID NO:492);

5'-UCUCAGAGUAUUAUGGAACGU-3'(SEQ ID NO:134) and 5'-ACGUUCCAUAAUACU-CUGAGAGA-3'(SEQ ID NO:493);

5'-UCAGAGUAUUAUGGAACGAGU-3'(SEQ ID NO:135) and 5'-ACUCGUUCCAUAAUACU-CUGAGA-3'(SEQ ID NO:494); and 5'-CAGAGUAUUAUGGAACGAGCU-3'(SEQ ID NO:136) and 5'-AGCUCGUUCCAUAAUACU-CUGAG-3'(SEQ ID NO:495).

11. The dsRNA agent of claim 10, wherein the sense strand and the antisense strand comprise nucleotide sequences selected from the group consisting of 5'-asgsgaucUfcUfCfUfcagaguauuu-3'(SEQ ID NO:844) and 5'-asAfsaudAc(Tgn)cugagaGfaGfauccusgsg-3' (SEQ ID NO:1203);

5'-gsgsaucuCfuCfUfCfagaguauuau-3'(SEQ ID NO:845) and 5'-asUfsaadTa(C2p)ucugagAfgAfgauccsusg-3 '(SEQ ID NO:1204);

5'-gsasucucUfcUfCfAfgaguauuauu-3'(SEQ ID NO:846) and 5'-asAfsuaaUfacucugaGfaGfagaucscsu-3 '(SEQ ID NO:1205);

5'-asuscucuCfuCfAfGfaguauuaugu-3'(SEQ ID NO:847) and 5'-asCfsauaAfuacucugAfgAfgagauscsc-3'(SEQ ID NO:1206);

5'-uscsucucUfcAfGfAfguauuauggu-3'(SEQ ID NO:848) and 5'-asCfscauAfauacucuGfaGfagagasusc-3 '(SEQ ID NO:1207);

5'-csuscucuCfaGfAfGfuauuauggau-3'(SEQ ID NO:849) and 5'-asUfsccaUfaauacucUfgAfgagagsasu-3'(SEQ ID NO:1208);

5'-uscsucucAfgAfGfUfauuauggaau-3'(SEQ ID NO:850) and 5'-asUfsuccAfuaauacuCfuGfagagasgsa-3'(SEQ ID NO:1209);

5'-csuscucaGfaGfUfAfuuauggaacu-3'(SEQ ID NO:851) and 5'-asGfsuudCc(Agn)uaauacUfcUfgagagsasg-3' (SEQ ID NO:1210);

5'-uscsucagAfgUfAfUfuauggaacgu-3'(SEQ ID NO:852); and 5'-asCfsguuCfcauaauaCfuCfugagasgsa-3'(SEQ ID NO:1211);

5'-uscsagagUfaUfUfAfuggaacgagu-3'(SEQ ID NO:853) and 5'-asCfsucgUfuccauaaUfaCfucugasgsa-3'(SEQ ID NO:1212); and 5'-csasgaguAfuUfAfUfggaacgagcu-3'(SEQ ID NO:854) and 5'-asGfscucGfuuccauaAfuAfcucugsasg-3'(SEQ ID NO:1213);

wherein a, g, c, and u are 2'-O-methyl (2'-OMe) A, G, C, and U, respectively; Af, Gf, Cf and Uf are 2'-fluoro A, G, C and U, respectively; s is a phosphorothioate linkage; dA is 2'-deoxyadenosine-3'-phosphate; (Tgn) is a thymidine-glycol nucleic acid (GNA)S-Isomer; dT is 2'-deoxythimidine-3'-phosphate; (C2p) is cytidine-2'-phosphate; and (Agn) is an adenosine-glycol nucleic acid (GNA)S-Isomer.

12. A pharmaceutical composition for inhibiting expression of a gene encoding xanthine dehydrogenase (XDH) comprising the dsRNA agent of claim 1.

13. A double stranded ribonucleic acid (dsRNA) agent for inhibiting expression of xanthine dehydrogenase (XDH) in a cell, wherein the dsRNA agent comprises a sense strand and an antisense strand forming a double stranded region, wherein the sense strand comprises at least 19 contiguous nucleotides differing by no more than 3 nucleotides from the nucleotide sequence of nucleotides 2701-2721 of SEQ ID NO: 1, and the antisense strand comprises at least 19 contiguous nucleotides from the corresponding nucleotide sequence of SEQ ID NO: 2, wherein all of the nucleotides of the sense strand and all of the nucleotides of the antisense strand are modified nucleotides, wherein the sense strand comprises two phosphorothioate internucleotide linkages at the 5'-terminus, and wherein the antisense strand comprises two phosphorothioate internucleotide linkages at the 5'-terminus and two phosphorothioate internucleotide linkages at the 3'-terminus.

14. The dsRNA agent of claim 13, wherein at least one of the modified nucleotides is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a nucleotide comprising a 2'-phosphate, a thermally destabilizing nucleotide, a glycol modified nucleotide (GNA), and a 2-O—(N-methylacetamide) modified nucleotide; and combinations thereof.

15. The dsRNA agent of claim 13, wherein the sense strand and the antisense strand are each independently 19-25 nucleotides in length.

16. The dsRNA agent of claim 15, further comprising a ligand.

17. The dsRNA agent of claim 16, wherein the ligand is conjugated to the 3' end of the sense strand of the dsRNA agent.

18. The dsRNA agent of claim 17, wherein the ligand is one or more GalNAc derivatives attached through a monovalent, bivalent, or trivalent branched linker.
19. The dsRNA agent of claim 18, wherein the ligand is
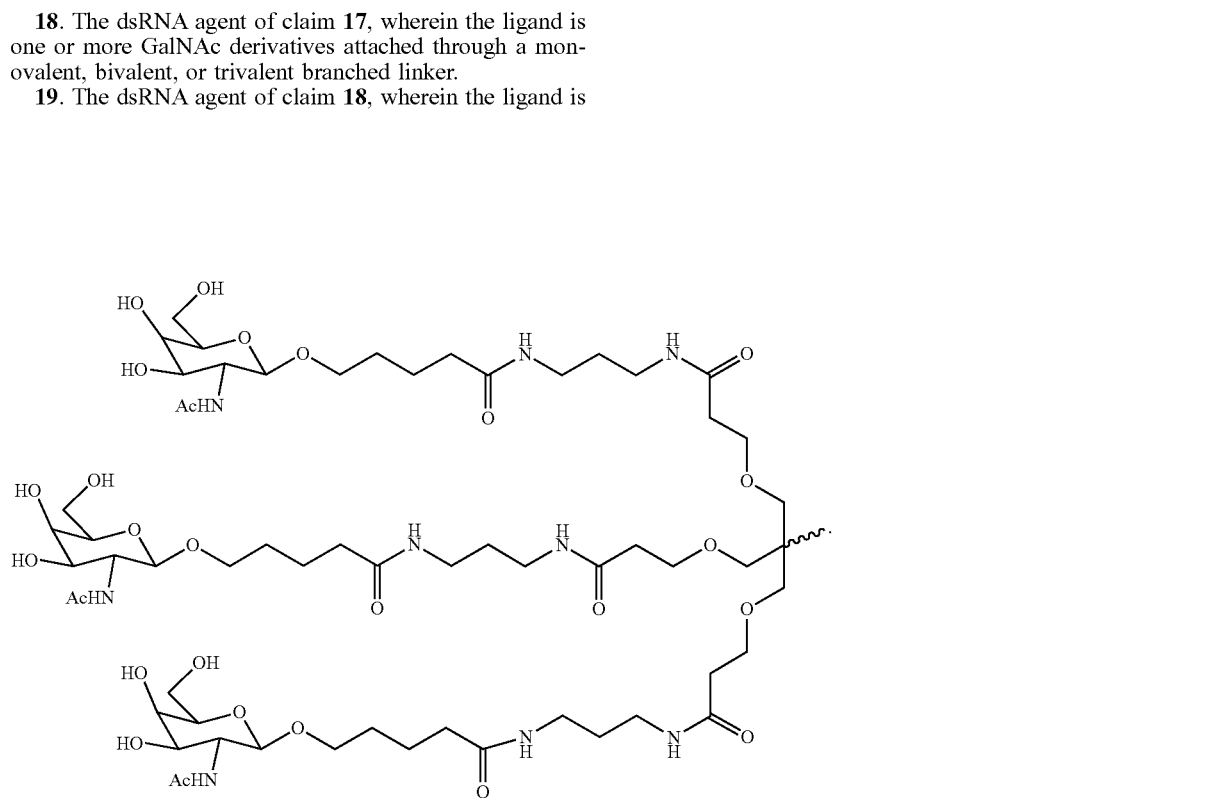
20. The dsRNA agent of claim 19, wherein the dsRNA agent is conjugated to the ligand as shown in the following schematic
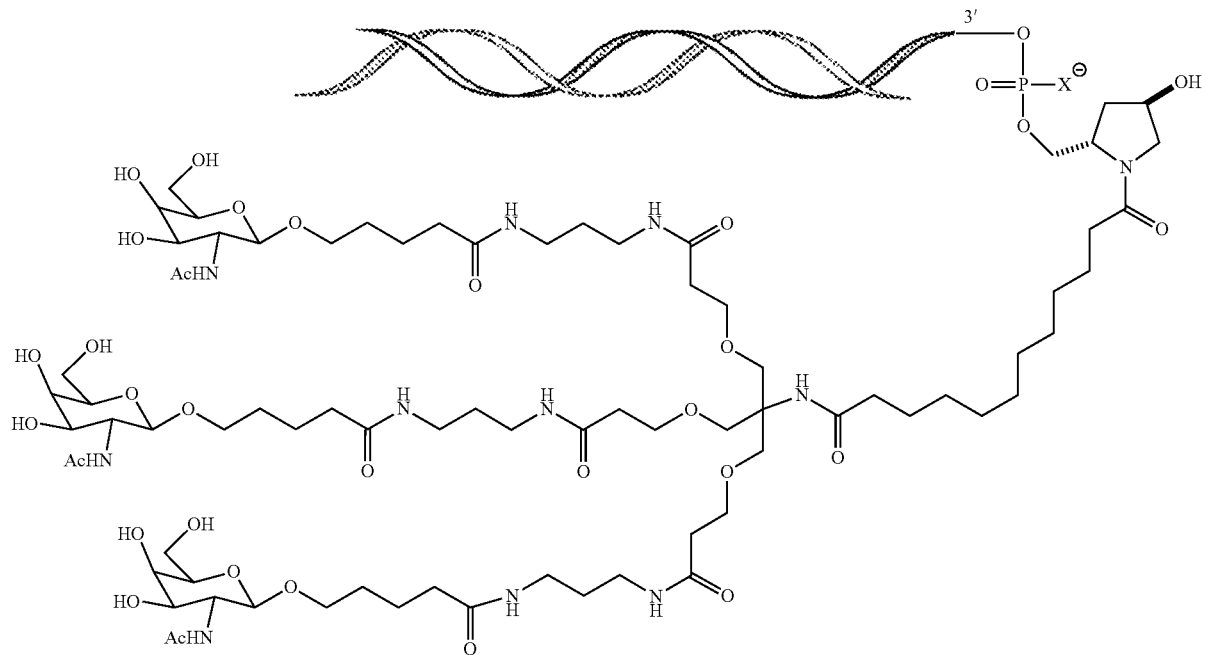
and, wherein X is O or S.

21. The dsRNA agent of claim 13, wherein the antisense strand comprises the nucleotide sequence 5'-ACUCGUUC-CAUAAUACUCUGAGA-3'(SEQ ID NO:494).

22. The dsRNA agent of claim 21, wherein the sense strand comprises the nucleotide sequence 5'-UCAG-AGUAUUAUGGAACGAGU-3'(SEQ ID NO:135) and the antisense strand comprise the nucleotide sequence 5'-ACUCGUUCCAUAAUACUCUGAGA-3'(SEQ ID NO:494).

23. The dsRNA agent of claim 22, wherein the sense strand comprises the nucleotide sequence 5'-uscsagagUfaU-fUfAfuggaacgagu-3'(SEQ ID NO:853) and the antisense strand comprises the nucleotide sequence 5'-asCfsucgUfuc-cauaaUfaCfucugasgsa-3'(SEQ ID NO:1212), wherein a, g, c, and u are 2'-O-methyl (2'-OMe) A, G, C, and U, respectively; Af, Gf, Cf and Uf are 2'-fluoro A, G, C and U, respectively; and s is a phosphorothioate linkage.

24. The dsRNA agent of claim 23, further comprising a ligand.

25. The dsRNA agent of claim 24, wherein the 3'-end of the sense strand is conjugated to a ligand as shown in the following schematic

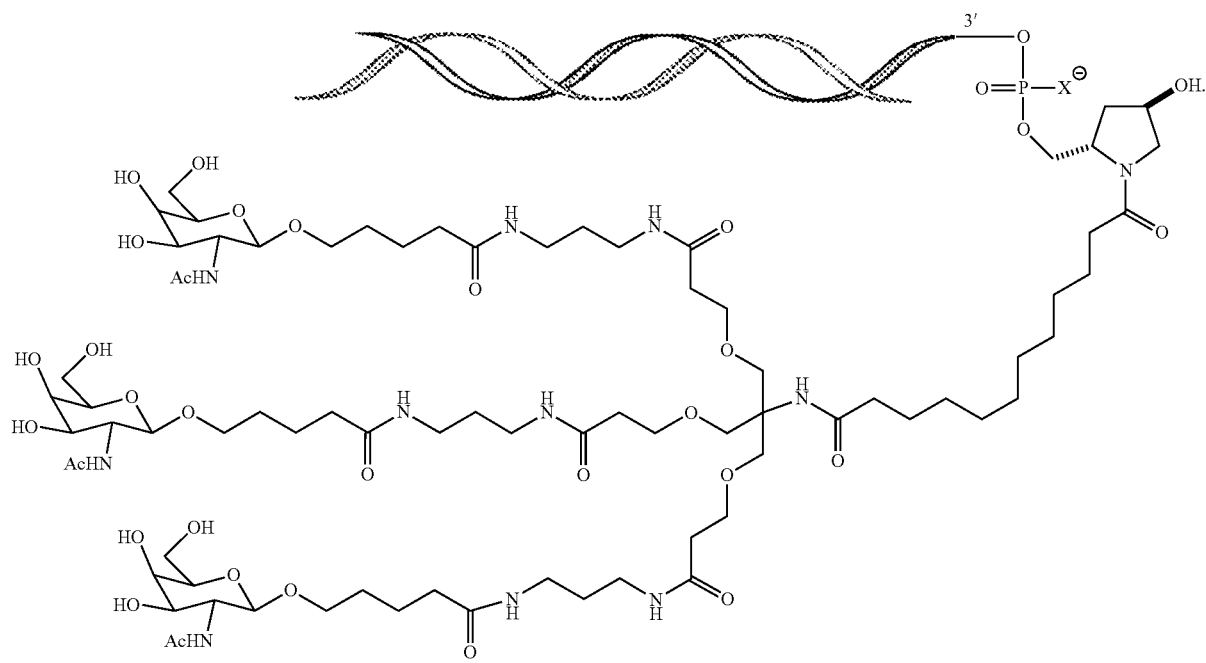

wherein X is O.

26. A pharmaceutical composition for inhibiting expression of a gene encoding xanthine dehydrogenase (XDH) comprising the dsRNA agent of claim 13.

27. A double stranded ribonucleic acid (dsRNA) agent for inhibiting expression of xanthine dehydrogenase (XDH) in a cell,
  wherein the dsRNA agent comprises a sense strand and an antisense strand forming a double stranded region,
  wherein the sense strand comprises the nucleotide sequence 5'-uscsagagUfaUfUfAfuggaacgagu-3'(SEQ ID NO:853) and the antisense strand comprises the nucleotide sequence 5'-asCfsucgUfuccauaaUfaCfucugasgsa-3'(SEQ ID NO:1212),
  wherein a, g, c, and u are 2'-O-methyl (2'-OMe) A, G, C, and U, respectively; Af, Gf, Cf and Uf are 2'-fluoro A, G, C and U, respectively; and s is a phosphorothioate linkage; and
  wherein the 3'-end of the sense strand is conjugated to a ligand as shown in the following schematic

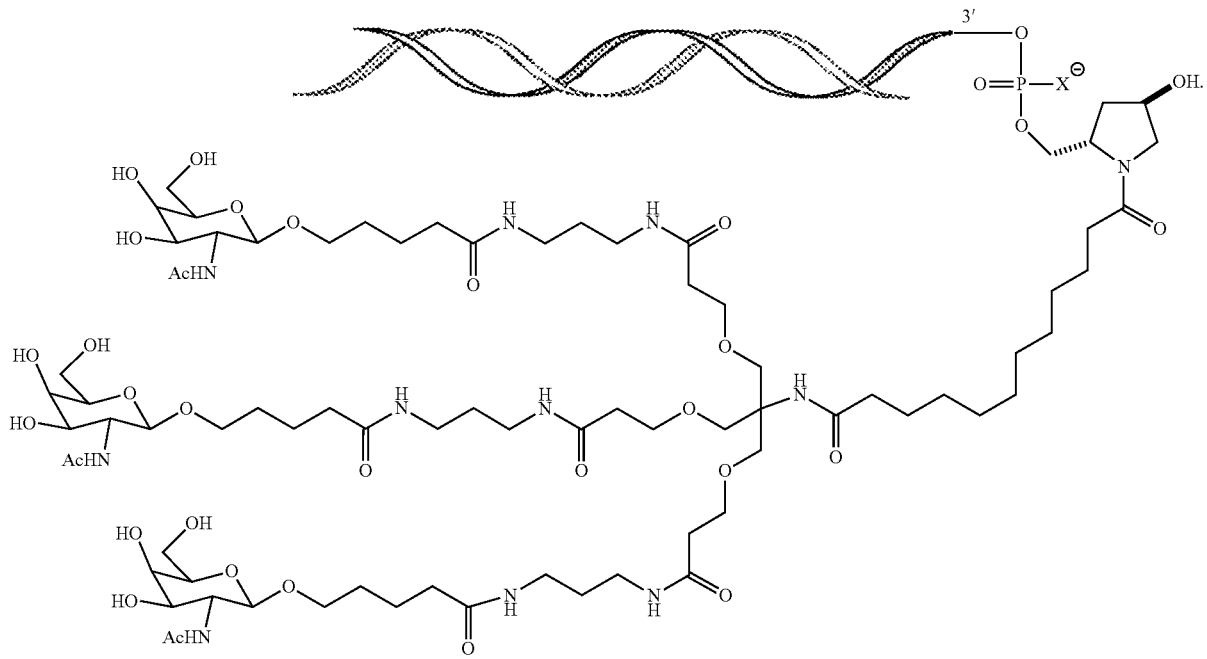

wherein X is O.

28. The dsRNA agent of claim 27, wherein the sense strand consists of the nucleotide sequence 5'-uscsagagUfaUfUfAfuggaacgagu-3'(SEQ ID NO:853) and the antisense strand consists of the nucleotide sequence 5'-asCfsucgUfuccauaaUfaCfucugasgsa-3'(SEQ ID NO:1212).

29. A pharmaceutical composition for inhibiting expression of a gene encoding xanthine dehydrogenase (XDH) comprising the dsRNA agent of claim 27.

* * * * *